(12) United States Patent
Lee et al.

(10) Patent No.: US 11,123,361 B2
(45) Date of Patent: *Sep. 21, 2021

(54) DOUBLE-STRANDED OLIGO RNA STRUCTURE COMPRISING MIRNA

(71) Applicant: BIONEER CORPORATION, Daejeon (KR)

(72) Inventors: Taewoo Lee, Seoul (KR); Sanghyung Shim, Daejeon (KR); Ungsik Yu, Daejeon (KR); Han-Oh Park, Daejeon (KR)

(73) Assignee: BIONEER CORPORATION, Daejeon (KR)

( * ) Notice: Subject to any disclaimer, the term of this patent is extended or adjusted under 35 U.S.C. 154(b) by 0 days.

This patent is subject to a terminal disclaimer.

(21) Appl. No.: 16/302,670

(22) PCT Filed: Aug. 24, 2017

(86) PCT No.: PCT/KR2017/009271
§ 371 (c)(1),
(2) Date: Nov. 18, 2018

(87) PCT Pub. No.: WO2018/038558
PCT Pub. Date: Mar. 1, 2018

(65) Prior Publication Data
US 2020/0179432 A1    Jun. 11, 2020

(30) Foreign Application Priority Data
Aug. 24, 2016    (KR) .................. 10-2016-0107937

(51) Int. Cl.
*A61K 48/00*    (2006.01)
*C12N 15/11*    (2006.01)
(Continued)

(52) U.S. Cl.
CPC ............ *A61K 31/713* (2013.01); *A61K 31/25* (2013.01); *A61P 35/00* (2018.01); *C12N 15/1135* (2013.01); *C12N 2310/141* (2013.01)

(58) Field of Classification Search
CPC .............. C12N 15/113; C12N 15/1135; C12N 2310/141; C12N 2310/351; A61K 31/713; A61K 47/60
See application file for complete search history.

(56) References Cited

U.S. PATENT DOCUMENTS 9,326,941 B2 *    5/2016    Chae .................. A61K 9/14
10,030,243 B2 *    7/2018    Park .................. A61P 43/00
(Continued)

FOREIGN PATENT DOCUMENTS

EP    3108209 A2    5/2016
EP    3128008 A2    2/2017
(Continued)

OTHER PUBLICATIONS

Cancer Research Wales. No Two Cancers are the Same, https://www.cancerresearchwales.co.uk/blog/no-two-cancers-are-the-same, downloaded on Aug. 19, 2020.*
(Continued)

*Primary Examiner* — Terra C Gibbs
(74) *Attorney, Agent, or Firm* — Hultquist, PLLC; Steven J. Hultquist (57) ABSTRACT

The present invention relates to a double-stranded oligo RNA structure comprising double-stranded miRNA, and a composition for preventing or treating cancer, containing the same. More specifically, the present invention relates to an anti-cancer pharmaceutical composition, containing: a double-stranded oligo RNA structure comprising miR-3670, miR-4477a and miR-8078, and characterized by a method for effectively inhibiting cancer cell proliferation or induc-
(Continued)

ing cancer cell apoptosis; and a pharmaceutically acceptable carrier.

15 Claims, 4 Drawing Sheets
(3 of 4 Drawing Sheet(s) Filed in Color)
Specification includes a Sequence Listing.

(51) Int. Cl.

| C07H 21/02 | (2006.01) |
|---|---|
| C07H 21/04 | (2006.01) |
| A61K 31/713 | (2006.01) |
| A61P 35/00 | (2006.01) |
| A61K 31/25 | (2006.01) |
| C12N 15/113 | (2010.01) |

(56) References Cited

U.S. PATENT DOCUMENTS 10,351,849 B2 * 7/2019 Lee .................. A61P 35/00
2009/0227533 A1 9/2009 Bader et al.

FOREIGN PATENT DOCUMENTS

| KR | 10-0883471 B1 | 2/2009 |
|---|---|---|
| KR | 1020090081125 A | 7/2009 |
| KR | 101224828 B | 1/2013 |
| KR | 101224828 B1 | 1/2013 |
| KR | 1020160033125 B | 3/2016 |
| WO | 2014100252 A1 | 6/2014 |
| WO | 2015005670 A1 | 1/2015 |
| WO | 2015152693 A2 | 10/2015 |
| WO | 2016137235 A2 | 9/2016 |

OTHER PUBLICATIONS

Will Glower. No, you cannot prevent all cancers, https://time.com/4519760/no-you-cant-prevent-all-cancers/ downloaded on Aug. 19, 2020.*
American Cancer Society Pancreatic Cancer Causes, Risk Factors, and Prevention, https://www.cancer.org/cancer/pancreatic-cancer/causes-risks-prevention/risk-factors.html downloaded on Aug. 19, 2020.*
Cleveland Clinic. Liver Cancer: Prevention, https://my.clevelandclinic.org/health/diseases/9418-liver-cancer/prevention downloaded on Aug. 19, 2020.*
Montanucci et al. (The Open Applied Informatics Journal 2(1) Jun. 2007, pp. 1-8).*
Zeng et al. (PNAS, 2003 vol. 100:9779-9784).*
Doench et al. (Genes & Development, 2003 vol. 17:438-442).*
Lam et al. (MolecularTherapy, 2015 vol. 4:pp. 1-19).*
Bajan et al. (Cells, 2020 vol. 9:pp. 1-27).*
Agostini, M., et al., "miR-34: from bench to bedside", "Oncotarget", Mar. 15, 2014, pp. 872-881, vol. 5, No. 4, Publisher: www.impactjournals.com/oncotarget.
Bartel, D., "MicroRNA Target Recognition and Regulatory Functions", "Cell", Jan. 23, 2009, pp. 215-233, vol. 136, No. 2, Publisher: NIH Public Access.
Bartolome, R., et al., "IL13 Receptor a2 Signaling Requires a Scaffold Protein, FAM120A, to Activate the FAK end PI3K Pathways in Colon Cancer Metastasis", "Cancer Research", Jun. 15, 2015, pp. 2434-2444, vol. 75, No. 12, Publisher: American Association for Cancer Research.
Brodersen, P., et al., "Revisiting principles of microRNA target recognition and mode of action", "Nature Reviews/Molecular Cell Biology", Feb. 2009, pp. 141-148, vol. 10, Publisher: Macmillan Publishers Limited.

Burnett, J., et al., "RNA-based Therapeutics—Current Progress and Future Prospects", "Chem Biol.", Jan. 27, 2012, pp. 60-71, vol. 19, No. 1, Publisher: NIH Public Access.
Carthew, R., et al., "Origins and Mechanisims of miRNAs and siRNAs", "Cell", Feb. 20, 2009, pp. 642-655, vol. 136, No. 4, Publisher NIH Public Access.
Chang, T.C., et al., "Transactivation of miR-34a by p53 broadly influences gene expression and promotes apoptosis", "Mol Cell", Jun. 8, 2007, pp. 745-752, vol. 26, No. 5, Publisher NIH Public Access.
Chu, C.Y., et al., "Potent RNAi by short RNA triggers", "RNA", 2008, pp. 1-6, vol. 14, Publisher: Ccole Spring Harbor Laboratory Press.
Dangwal, S., et al., "microRNA Therapeutics in Cardiovascular Disease Models", "The Annual Review of Pharmacology and Toxicology", 2014, pp. 185-203, vol. 54, Publisher: www.annualreviews.org.
Erez, A., et al., "Sil overexpression in lung cancer characterizes tumors with increased mitotic activity", "Oncogene", 2004, pp. 5371-5377, vol. 23, Publisher: Nature Publishing Group.
Erez, A., et al., "The Sil Gene Is Essential for Mitotic Entry and Survival of Cancer Cells", "Cancer Res.", Apr. 24, 2007, pp. 4022-4027 and p. 5998 correction on Jun. 15, 2007, vol. 67, No. 9, Publisher: American Association for Cancer Research.
Fujii, M., et al., "SNIP1 Is a Candidate Modifier of the Transcriptional Activity of c-Myc on E Box-Dependent Target Genes", "Molecular Cell", Dec. 8, 2006, pp. 771-783, vol. 24, Publisher: Elsevier Inc.
"*Homo sapiens* BAC clone CH17-292P3 from chromosome 16, complete sequence, AC269968.1", "GenBank", Sep. 18, 2017, Publisher: NCBI.
Hermeking, H., "The miR-34 family in cancer and apoptosis", "Cell Death and Differentiation", 2010, pp. 193-199, vol. 17, Publisher: Macmillan Publishers Limited.
Huang, X., et al., "RIPK4 phosphorylates Dishevelled proteins to regulate canonical Wnt signaling", "Science", Mar. 22, 2013, pp. 1441-1445, vol. 339, No. 6126, Publisher: NIH Public Access.
Jorns, E., et al., "Utilizing RNA interference to enhance cancer drug discovery", "Nature Reviews/Drug Discovery", Jul. 2007, pp. 556-568, vol. 6, Publisher: Nature Publishing Group.
Jackson, A., et al., "Expression profiling reveals "off-target" gene regulation by RNAi", "Nature Biotechnology", May 2003, pp. 635-637, vol. 21, Publisher: Nature Publishing Group.
Jackson, A., et al., "Position-specific chemical modification of siRNAs reduces "off-target" transcript silencing", "RNA", 2006, vol. 12, No. 1197-1205, Publisher: Cold Spring Harbor Laboratory Press.
Jackson, A., et al., "Widespread siRNA off target transcript silencing mediated by seed region complementarity", "RNA", 2006, pp. 1179-1187, vol. 12, Publisher: Cold Spring Harbor Laboratory Press.
Jeon, H.S., et al., "High expression of SNIP1 correlates with poor prognosis in Non small cell lung cancer and SNIP1 interferes with the recruitment of HDAC1 to RB in vitro", "Lung Cancer", 2013, pp. 24-30, vol. 82, Publisher: Elsevier Ireland Ltd.
Jiao, H-K, et al., "Prognostic significance of Cbx4 expression and its beneficial effect for transarterial mchemoembolization in hepatocellular carcinoma", "Cell Death and Disease", Mar. 12, 2015, p. e1689, vol. 6, Publisher: Macmillan Publishers Limited.
Kim, S., et al., "Local and systemic delivery of VEGF siRNA using polyelectrolyte complex micelles for effective treatment of cander", "Journal of Controlled Release", 2008, pp. 107-116, vol. 129, Publisher: Elsevier.
Landi, D., et al., "Role of variations within microRNA-binding sites in cancer", "Mutagenesis", 2012, pp. 205-210, vol. 27, No. 2, Publisher: Oxford University Press.
Laviolette, L., et al., "17-Estradiol upregulates GREB1 and accelerates ovarian tumor progression in vivo", "International Journal of Cancer", 2014, pp. 1072-1084, vol. 135, Publisher: Wiley Periodicals, Inc.
Li, Q., et al., "SNIP1: a new activator of HSE signaling pathway", "Mol Cell Biochem", 2012, pp. 16, vol. 362, Publisher: Springer Science & Business Media B.V.

(56) References Cited

OTHER PUBLICATIONS

Li, Y., et al., "The HECTD3 E3 ubiquitin ligase facilities cancer cell survival by promoting K63-linked polyubiquitination of caspase-8", "Cell Death and Disease", 2013, pp. 1-11, vol. 4, No. e935, Publisher: Macmillan Publishers Limited.
Li, Y., et al., "The HECTD3 E3 Ubiqitin Ligase Suppressses Cisplatin-Induced Apoptosis via Stabilizing MALT1", "Neoplasia", Jan. 2013, pp. 39-48, vol. 15, No. 1, Publisher: www.neoplasia.com.
Liang, X., et al., "Hypoxia-inducible factor-1 alpha, in association with TWIST2 and SNIP1, is a critical prognostic factor in patients with tongue squamous cell carcinoma", "Oral Oncology", 2011, pp. 92-97, vol. 47, Publisher: Elsevier.
Lin, Z, et al., "MicroRNA-224 inhibits progression of human prostate cancer by downregulating TRIB1", "International Journal fo Cancer", 2014, pp. 541-550, vol. 135, Publisher: UICC.
Logue J., et al., "AKAP220 Protein Organizes Signaling Elements That Impact Cell Migration", "The Journal of Biological Chemistry", Nov. 11, 2011, pp. 39269-39281, vol. 286, No. 45, Publisher: ASBMB.
Malone, C., et al., "Small RNAs as Guardians of the Genome", "Cell", Feb. 20, 2009, pp. 656-668, vol. 136, No. 4, Publisher: NIH Public Access.
Martens-De Kemp, S., et al., "Functional Genetic Screens Identify Genes Essential for Tumor Cell Survival in Head and Neck and Lung Cancer", "Clinical Cancer Research", Apr. 15, 2013, pp. 1994-2003, vol. 19, No. 8, Publisher: American Association for Cancer Research.
Mashidori, T., et al., "Increased alpha-taxilin protein expression is associated with the metastatic and invasive potential of renal cell cancer", "Biomedical Research", 2011, pp. 103-110, vol. 32, No. 2.
Madfarlane, L.-A., et al., "MicroRNA: Biogenesis, Function and Role in Cancer", "Current Genomics", 2010, pp. 537-561, vol. 11, Publisher: Bentham Science Publishers, Ltd.
Mittal, V., "Improving the Efficiency of RNA Interference in Mammals", "Nature Reviews/Genetics", May 2004, pp. 355-365, vol. 5, Publisher: Nature Publishing Group.
Nicoloso, M., et al., "MicroRNAs—the micro steering wheel of tumour metastases", "Nature Reviews/Cancer", Apr. 2009, pp. 293-302, vol. 9, Publisher: Macmillan Publishers Limited.
Nielsen, C., et al., "Detrminants of targeting by endogenous and exogenous microRNAs and siRNAs", "RNA", 2007, pp. 1894-1910, vol. 13, Publisher: Cold Spring Harbor Laboratory Press.
Ohashi, K., et al., "Characteristics of Lung Cancers Harboring NRAS Mutations", "Clin Cancer Res", May 1, 2013, pp. 2584-2591, vol. 19, No. 9, Publisher: NIH Public Access.
Ohtomo, N., et al., "Expression of—taxilin in hepatocellular carcinoma correlates with growth activity and malignant potential of the tumor", "International Journal of Oncology", 2010, pp. 1417-1423, vol. 37.
Orouji, E., et al., "MAP kinase pathway gene copy alterations in NRAS/BRAF wild-type advanced melanoma", "International Journal of Cancer", 2016, pp. 2257-2262, vol. 138, Publisher: UICC.
Pecina-Slaus, N., et al., "Wnt signaling transcription factors TCF-1 and LEF-1 are upregulated in malignant astrocytic brain tumors", "Histology and Histopathology", 2014, pp. 1557-1564, vol. 29, No. 12, Publisher: http://medlib.mef.hr/.
Peek, A., et al., "Design of active small interfering RNAs", "Current Opinion in Molecular Therapeutics", 2007, pp. 110-118, vol. 9, No. 2, Publisher: The Thomson Corporation ISSN.
Rae, J., et al., "GREB1 is a Novel Androgen-Regulated Gene Required for Prostate Cancer Growth", "The Prostate", 2006, pp. 886-894, vol. 66, Publisher: Wiley-Liss, Inc.
Reynolds, A., et al., "Rational siRNA design for RNA interference", "Nature Biotechnology", Mar. 2004, pp. 326-330, vol. 22, No. 3, Publisher: Nature Publishing Group.

"Regulation of ATR-dependent pathways by the FHA domain containing protein SNIP1", "Oncogene", 2007, pp. 4523-4530, vol. 26, Publisher: Nature Publishing Group.
Shan, N., et al., "MiR-153 inhibits migration and invasion of human non-small-cell lung cancer by targeting ADAM19", "Biochemical and Biophysical Research Communications", 2015, pp. 385-391, vol. 456, Publisher: Elsevier.
Soubeyrand, S., et al., "ERK1/2 regulates hepatocyte Trib1 in response to mitochondrial dysfunction", "Biochimica et Biophysica Acta", 2013, pp. 3405-3414, vol. 1833, Publisher: Elsevier.
Soutschek, J., et al., "Therapeutic silencing of an endogenous gene by systemic administration of modified siRNAs", "Nature", Nov. 2004, pp. 173-178, vol. 432, Publisher: Nature Publishing Group.
Tanaka, M., et al., "A Novel RNA-Binding Protein, Ossa/C9orl10, Regulates Activity of Src Kinases to Protect Cells from Oxidative Stress-Induced Apoptosis", "Molecular and Cellular Biology", Jan. 2009, pp. 402-413, vol. 29, No. 2, Publisher: American Society for Microbiology.
Tang, Y., et al., "Rapid induction of apoptosis during Kinesin-5 inhibitor-induced mitotic arrest in HL60 cells", "Cancer Letters", 2011, pp. 15-24, vol. 310, Publisher: Elsevier.
Tanji, C., et al., "A-Kinase Anchoring Protein AKAP220 Binds to Glycogen Synthase Kinase-3 (GSK-3) and Mediates Protein Kinase A-dependent Inhibition of GSK-3", "The Journal of Biological Chemistry", Oct. 4, 2002, pp. 36955-36961, vol. 277, No. 40, Publisher: The American Society for Biochemistry and Moleular Biology, Inc.
Tennakoon, S., et al., "The calcium-sensing receptor and the hallmarks of cancer", "Biochimica et Biophysica Acta", 2016, pp. 1398-1407, Publisher: Elsevier.
Tomari, Y., et al., "Perspective: machines for RNAi", "Genes & Development", 2005, pp. 517-529, vol. 19, Publisher: Cold Spring Harbor Laboratory Press.
Ueno, K., et al., "Tumor suppressor microRNA-493 decreases cell motility and migration ability in human bladder cancer cells downregulating RhoC and FZD4", "Mol Cancer Ther.", Jan. 11, 2012, pp. 244-253, vol. 11, No. 1, Publisher: NIH Public Access.
Van Rooij, E., et al., "Developing MicroRNA Therapeutics", "Circulation Research", 2012, pp. 496-507, vol. 110, Publisher: http://circres.ahajournals.org.
Venere, M., et al., "The Mitotic Kinesin KIF11 is a Central Driver of Invasion, Proliferation, and Self Renewal in Glioblastoma", "Sci Transl Med.", Sep. 9, 2015, p. 304ra143, 1-27, vol. 7, No. 304, Publisher: HHS Public Access.
Whiting, J., et al., "Protein Kinase A Opposes the Phosphorylation-dependent Recruitment of Glycogen Synthase Kinase 3 to A-kinase Anchoring Protein 220", "The Journal of Biological Chemistry", Aug. 7, 2015, pp. 19445-19457, vol. 290, No. 32, Publisher: The American Society for Biochemistry and Molecular Biology.
Wiggins, J., et al., "Development of a lung cancer therapeutic based on the tumor suppressor microRNA-34", "Cancer Res.", Jul. 15, 2010, pp. 5923-5930, vol. 70, No. 17, Publisher: NIH Public Access.
Zhang, L, et al., "Development of transcritomic biomarker signature in human saliva to detect lung cancer", "Cellular and Molecular Life Sciences", 2012, pp. 3341-3350, vol. 69, Publisher: Springer.
Zhang, Q., et al, "Role of microRNA-30c Targeting ADAM19 in Colorectal Cancer", "PLOS ONE", Mar. 23, 2015, pp. 1-14, e0120698, vol. 10, No. 3, Publisher: journal.pone.0120698.
Zheng, C., et al., "microRNA-195 functions as a tumor suppressor by inhibiting CBX4 in hepatocellular carcinoma", "Oncology Reports", 2015, pp. 1115-1122, vol. 33, Publisher: Spandidos Publications UK Ltd.
Zhang, Y., et al., "MicroRNA Expression Profile on Solid Subtype of Invasive Lung Adenocarcinoma Reveals a Panel of Four miRNAs to be Associated with Poor Prognosis in Chinese Patients", "Journal of Cancer", 2016, pp. 1610-1620, vol. 7.

* cited by examiner

DOUBLE-STRANDED OLIGO RNA STRUCTURE COMPRISING MIRNA

CROSS-REFERENCE TO RELATED APPLICATIONS

This application is a U.S. national phase under the provisions of 35 U.S.C. § 371 of International Patent Application No. PCT/KR17/09271 filed Aug. 24, 2017, which in turn claims priority under 35 U.S.C. §119 of Korean Patent Application No. 10-2016-0107937 filed Aug. 24, 2016. The disclosures of such international patent application and Korean priority patent application are hereby incorporated herein by reference in their respective entireties, for all purposes.

TECHNICAL FIELD

The present invention relates to a double-stranded oligo RNA structure containing double-stranded miRNA and a composition for preventing or treating cancer containing the same. More specifically, the present invention relates to an anti-cancer pharmaceutical composition containing a double-stranded oligo RNA structure comprising miR-3670, miR-4477a and miR-8078, effectively inhibiting proliferation of cancer cells or inducing apoptosis of cancer cells, and a pharmaceutically acceptable carrier.

BACKGROUND ART

Surgical removal of tumors has been used as an effective and traditional treatment method for diseases caused by failure of normal control of genes, which are typically referred to as cancer. However, when primary cancer metastasizes to other organs, anticancer drug therapy is used due to impossibility of surgical operation. Anticancer drugs used for drug therapy are generally monomolecular substances synthesized by an organic or inorganic method. Anticancer drugs have been developed and used in order to inhibit activities of proteins by effectively binding to the proteins that disrupt signal transduction pathways through over-expression of phosphorylation factor proteins contained in signal transduction pathways. Such traditional drug therapy involves many side effects, which include that the substance used as a drug is an artificially synthesized exogenous substance and that actions of anticancer substances target already over-expressed proteins.

The development of drug therapies to replace the traditional drug treatment methods has progressed in many ways, one of which is the use of small interfering RNAs (hereinafter referred to as "siRNAs"). (Iorns, E., Lord, C. J., Turner, N. & Ashworth, A. Utilizing RNA interference to enhance cancer drug discovery. Nat Rev Drug Discov 6, 556-68. 2007.). siRNAs are single-stranded RNAs including 16 to 27 nucleotides, which act as constituent components of ribonucleoproteins known as RISCs (RNA Induced Silencing complexes) (Tomari, Y. & Zamore, P. D. Perspective: machines for RNAi. Genes Dev 19, 517-29, 2005, Chu, C. Y. & Rana, T. M. Potent RNAi by short RNA triggers. Rna 14, 1714-9, 2008, Mittal, V. Improving the efficiency of RNA interference in mammals. Nat Rev Genet 5, 355-65, 2004, Reynolds, A. et al. Rational siRNA design for RNA interference. Nat Biotechnol 22, 326-30. 2004). RISCs function as RNA enzyme scissors, that is, RISCs cleave messenger RNAs (hereafter referred to as "mRNAs") to inhibit the production of proteins from mRNAs. The siRNAs contained in RISCs bind to mRNAs having sequences complementary to the siRNAs sequences to form double-stranded RNAs. The RISCs act as RNA enzyme scissors to cleave the target mRNAs, thus preventing mRNAs from acting as templates to repeatedly produce proteins.

Such siRNA-based anti-cancer agents are considered to be more advanced than the above-mentioned anticancer agents in that the siRNA-based anti-cancer agents block mRNAs before protein production and use RNAs and intracellular RISC systems. However, there are side effects called "off-target effects" that cannot be solved by siRNA-based technologies (Jackson, A. L. et al. Widespread siRNA "off-target" transcript silencing mediated by seed region sequence complementarity. Rna 12, 1179-87, 2006., Jackson, A. L. et al. Position-specific chemical modification of siRNAs reduces "off-target" transcript silencing. Rna 12, 1197-205, 2006., Jackson, A. L. et al. Expression profiling reveals off-target gene regulation by RNAi. Nat Biotechnol 21, 635-7, 2003., Nielsen, C. B. et al. Determinants of targeting by endogenous and exogenous microRNAs and siRNAs. Rna 13, 1894-910, 2007., Peek, A. S. & Behlke, M. A. Design of active small interfering RNAs. Curr Opin Mol Ther 9, 110-8, 2007.). As described above, siRNA-based anti-cancer agents degrade mRNAs that bind complementarily to siRNA sequences. However, the siRNA-based anti-cancer agents bind to even mRNAs which are not complementary to the entirety of siRNA sequences and are complementary to the part thereof, thus causing degradation, which is called a "off-target effect", meaning causing degradation of non-target mRNAs.

In order to overcome technical difficulties of the aforementioned siRNA-based anticancer drugs, research is underway to use microRNAs (hereinafter referred to as miRNAs) as therapeutic agents (Agostini, M. & Knight, R. A. miR-34: from bench to bedside. Oncotarget 5, 872-81, 2014., van Rooij, E., Purcell, A. L. & Levin, A. A. Developing MicroRNA Therapeutics. Circulation Research 110, 496-507, 2012., Burnett, J. C. & Rossi, J. J. RNA-based therapeutics: current progress and future prospects. Chem Biol 19, 60-71, 2012., Dangwal, S. & Thum, T. microRNA therapeutics in cardiovascular disease models. Annu Rev Pharmacol Toxicol 54, 185-203, 2014.). miRNAs are RNAs composed of 16 to 27 nucleotides, which are classified as protein non-coding RNAs as compared to messenger RNAs (mRNAs) that are translated into proteins (Carthew, R. W. & Sontheimer, E. J. Origins and Mechanisms of miRNAs and siRNAs. Cell 136, 642-55, 2009., MacFarlane, L. A. & Murphy, P. R. MicroRNA: Biogenesis, Function and Role in Cancer. Current Genomics 11, 537-561, 2010., Bartel, D. P. MicroRNAs: target recognition and regulatory functions. Cell 136, 215-33, 2009.). miRNAs are recorded in the genomes of higher plant and animal cells and are known to play a key role in regulating cell metabolism and functions, including cell production, growth, differentiation and death. To date, about 2,000 types of miRNAs have been found in the human genome, the function of many of these miRNAs are still unknown.

miRNAs are transcribed from the genomes into RNAs by an RNA polymerase called "Pol II", the initial length of which is too variable to be specified (Carthew, R. W. & Sontheimer, E. J. Origins and Mechanisms of miRNAs and siRNAs. Cell 136, 642-55, 2009., Brodersen, P. & Voinnet, O. Revisiting the principles of microRNA target recognition and mode of action. Nat Rev Mol Cell Biol 10, 141-148, 2009.). This is due to the diversity of the location of the miRNA in the genome. That is, miRNA is produced in many ways, for example, miRNA is located in an intron, which is a part not involved in the protein production of mRNAs, and is transcribed at the same time as in production of mRNAs, or miRNA is located in the intergenic region on the genome and is transcribed independently (Malone, C. D. & Hannon, G. J. Small RNAs as guardians of the genome. Cell 136, 656-68, 2009.). miRNA produced at an early stage is called "primary microRNA", and the primary miR is edited into the precursor miRNA (precursor miRNA, pre-miR) by an RNA-cleaving enzyme (RNase) called "Drosha" in the nucleus (Bartel, D. P. MicroRNAs: target recognition and regulatory functions. Cell 136, 215-33, 2009.). Pre-miR has an RNA hairpin structure consisting of approximately 70 to 80 nucleotides. Pre-miR inside the cell nucleus is transported from the nucleus to the cytoplasm by exportin proteins, and is secondarily processed by another RNA-cleaving enzyme (RNase) called "Dicer" in the cytoplasm to produce double-stranded mature microRNAs (hereinafter referred to as "miRs" without any other modifiers) composed of 16 to 27 nucleotides. RNA of one strand of the double-stranded miRs is selectively determined, has activity by binding to the ribonucleoprotein complex, RISC, and binds to the target mRNA using the miR sequence.

In general, mRNAs can be divided into three parts based on involvement in protein production. That is, mRNAs can be divided into a coding region having protein translation information, and the 5' and 3' parts of the coding region having no protein translation information, respectively, 5'-UTR (untranslated region) and 3'-UTR. siRNAs, which cause degradation of target mRNAs using complementary sequences, act regardless of the 5'-UTR, 3'-UTR and coding parts of the mRNA, whereas miRs bind primarily to the 3'-UTR ((Carthew, R. W. & Sontheimer, E. J. Origins and Mechanisms of miRNAs and siRNAs. Cell 136, 642-55, 2009., Bartel, D. P. MicroRNAs: target recognition and regulatory functions. Cell 136, 215-33, 2009.).

The unique features of miRNAs distinguished from siRNAs, in addition to their binding sites to the mRNAs, are that the siRNAs bind primarily to mRNAs containing sequences complementary to the entire siRNA sequence, while, regarding the miRNAs, seed region sequences with a limited size, located at nucleotides at positions of 2 to 8 from the 5' end, are mainly used to recognize target mRNAs, so the sequence of the entire miRNA does not have a perfectly complementary sequence with the target gene, and although it contains even a part of the non-complementary sequence, it does not affect miRNA activity (Bartel, D. P. MicroRNAs: target recognition and regulatory functions. Cell 136, 215-33, 2009.). Since the sequence size of the seed region is 6 to 8 nucleotides, there are various mRNA types having the sequence complementary thereto in the 3' UTR. For this reason, it is possible to simultaneously control several types of mRNAs with one type of miRNA. The properties of these miRNAs impart, to miRNAs, functions as efficient regulators that are involved in controlling various cell physiological properties that entail cell division, growth, differentiation and death. In addition, the functions of miRNAs as regulators are advantageous in achieving effective anticancer effects because siRNAs target the suppression of single gene expression, while miRNAs simultaneously inhibit the expression of many cancer-inducing genes.

A large number of mRNAs contain portions of the 3' UTR to which one or more types of miRNAs are likely to bind, and one bioinformatic calculation shows that protein production of approximately 30% of the total mRNA is regulated by miRNAs.

The fact that miRNAs act as major regulators in signaling pathways of mRNAs can be identified in that they play a key role in major diseases including cancer (MacFarlane, L.-A. & Murphy, P. R. MicroRNA: Biogenesis, Function and Role in Cancer. Current Genomics 11, 537-561. 2010., Malone, C. D. & Hannon, G. J. Small RNAs as guardians of the genome. Cell 136, 656-68. 2009., Nicoloso, M. S., Spizzo, R., Shimizu, M., Rossi, S. & Calin, G. A. MicroRNAs--the micro steering wheel of tumour metastases. Nat Rev Cancer 9, 293-302. 2009., Landi, D., Gemignani, F. & Landi, S. Role of variations within microRNA-binding sites in cancer. Mutagenesis 27, 205-10. 2012.). In fact, several studies have shown that expression patterns of miRNAs in cancer cells differ greatly from the expression patterns of miRNAs in normal cells. In addition, there is a great difference in miRNA expression patterns depending on the primary organs in which cancer occurs. Various types of cancers such as lung cancer, liver cancer, skin cancer and blood cancer have unique miRNA expression patterns, which indicates that miRNAs have a pivotal role in cancer biology. In particular, the levels of miRNAs expressed in carcinomas are known to be generally lower than levels of miRNAs expressed in normal cells.

Recently, attempts have been made to use miRNAs as therapeutic agents based on the aforementioned close correlation of miRNAs with cancer. For example, clinical testing is underway to identify the ability of miRNAs called "miR-34a" to inhibit proliferation of cancer cells and induce apoptosis (Wiggins, J. F. et al. Development of a lung cancer therapeutic based on the tumor suppressor microRNA-34. Cancer Res 70, 5923-30. 2010., Bader, A. G. et al. miR-34 Regulated Genes and Pathways as Targets for Therapeutic Intervention. Google Patents, 2009., Hermeking, H. The miR-34 family in cancer and apoptosis. Cell Death Differ 17, 193-9. 2010., Chang, T. C. et al. Transactivation of miR-34a by p53 broadly influences gene expression and promotes apoptosis. Mol Cell 26, 745-52. 2007.).

In order to use miRNA as an anticancer agent, there is a need for an effective method for transferring miRNAs injected from the outside of the living body to pathological tissues without degradation of miRNAs in the living body. For this purpose, RNA oligo structures containing miRNA sequences can be used. It is known that a high efficiency can be induced in vivo by linking a chemical substance or the like to the terminal site of RNA oligos so as to provide enhanced pharmacokinetic characteristics (Nature 11; 432 (7014):173-8, 2004). The stability of the RNA oligos depends on the nature of chemical substance bound to the ends of sense (passenger) or antisense (guide) strands of RNA oligos. For example, an RNA oligo, which is conjugated with a polymer compound such as polyethylene glycol (PEG), interacts with an anionic phosphate group of oligo in the presence of a cationic substance to form a complex, which can become a carrier with improved stability (J Control Release 129 (2): 107-16, 2008). In particular, micelles composed of polymer complexes are extremely small in size, very uniform in distribution and are spontaneously formed, as compared with other systems used as drug delivery carriers, such as microspheres or nanoparticles, thus having advantages of easy quality control of preparations and reproducibility.

Further, in order to improve intracellular delivery efficiency of RNA oligos, techniques for securing the stability of oligos and for securing efficient cell membrane permeability through oligo conjugates wherein RNA oligos are simply bonded to a hydrophilic substance (polyethylene glycol (PEG)) as a biocompatible polymer via a simple covalent bond or a linker-mediated covalent bond have been developed (Korean Patent No. 10-0883471). However, chemical modification of oligo and conjugation of polyethylene glycol (PEG) still do not solve the drawbacks of low in vivo stability and non-favorable delivery to target organs. In order to solve these drawbacks, double-stranded oligo RNA structures in which hydrophilic and hydrophobic substances are bonded to double-stranded oligo RNAs have been developed. These structures form self-assembled nanoparticles called "SAMiRNA™" (self-assembled micelle inhibitory RNAs) via hydrophobic interaction of hydrophobic substances (See Korean Patent No. 10-1224828), and this SAMiRNA™ technology has advantages of obtaining much smaller and more homogenous nanoparticles than conventional delivery technologies.

Under these technical backgrounds, as a result of efforts to find miRNAs with excellent efficacies to inhibit proliferation of cancer cells and induce death of cancer cells, the present inventors found miR-3670, miR-4477a and miR-3477a with excellent anticancer efficacy, and identified that these miRNAs and double-stranded oligo RNA structures containing the same effectively inhibited the expression of a number of genes known as cancer-inducing genes to achieve anticancer effects, thus completing the present invention.

DISCLOSURE

Technical Problem

It is an object of the present invention to find miRNAs with excellent efficacies to inhibit proliferation of cancer cells and induce death of cancer cells, and provide double-stranded oligo RNA structures containing the same and a composition for preventing or treating cancer containing the same as an active ingredient.

Technical Solution

To accomplish the object, the present invention provides a double-stranded oligo RNA structure comprising the following Formula (1):

A-X-R-Y-B   Formula (1)

wherein A represents a hydrophilic material, B represents a hydrophobic material, X and Y each independently represent a simple covalent bond or a linker-mediated covalent bond, and R represents at least one miRNA selected from the group consisting of miR-3670, miR-4477a, and miR-8078.

The present invention also provides a composition for preventing or treating cancer comprising the oligonucleotide structure.

BRIEF DESCRIPTION OF THE DRAWINGS

The patent or application file contains at least one drawing executed in color. Copies of this patent or patent application publication with color drawing(s) will be provided by the Office upon request and payment of the necessary fee.

BEST MODE

Unless defined otherwise, all technical and scientific terms used herein have the same meaning as those appreciated by those skilled in the field to which the present invention pertains. In general, nomenclature used herein is well-known in the art and is ordinarily used.

According to the present invention, miRNAs having better efficacies than miR-34a known to have anticancer effects are found and anti-cancer effects thereof are identified.

According to the present invention, 1,700 types of miRNA screening libraries are synthesized (Example 1), NCI-H460 (lung cancer cell line) cells are treated with the miRNA screening libraries, and the ability to suppress growth of cancer cells is measured, as a result, miR-3670, miR-4477a and miR-8078 having the following base sequences (Table 3) have found to have better efficacies than miR-34a, so that it is identifed that miR-3670, miR-4477a and miR-8078 have excellent anticancer efficacies (FIGS. 4 to 8).

Accordingly, the present invention is directed to a double-stranded oligo RNA structure that comprises at least one miRNA selected from the group consisting of miR-3670, miR-4477a and miR-8078, and the structure represented by the following Formula (1):

A-X-R-Y-B   Formula (1)

wherein A represents a hydrophilic material, B represents a hydrophobic material, X and Y each independently represent a simple covalent bond or a linker-mediated covalent bond, and R represents at least one miRNA selected from the group consisting of miR-3670, miR-4477a, and miR-8078.

According to the present invention, miR-3670 may be a double stranded RNA comprising a base sequence of SEQ ID NO. 35; and a base sequence of SEQ ID NO. 36 or SEQ ID NO. 67.

According to the present invention, miR-4477a may be a double stranded RNA comprising a base sequence of SEQ ID NO. 43; and a base sequence of SEQ ID NO. 44 or SEQ ID NO. 68.

According to the present invention, miR-8078 may be a double stranded RNA comprising a base sequence of SEQ ID NO. 65; and a base sequence of SEQ ID NO. 66 or SEQ ID NO. 69.

That is, the template strand of miR-3670 may be represented by SEQ ID NO. 35.

```
                      (MIMAT0018093. SEQ ID NO. 35)
5'-AGAGCUCACAGCUGUCCUUCUCUA-3'
``` miRNAs are ultimately active in vivo as single-strands, but should be fed into cells in the form of double strands with a base sequence having a similar base size for binding to RISC. At this time, the antisense binding to the active sequence has a complementary sequence to the active sequence. The complementary sequence has a perfect complementary sequence or an in vivo endogenous sequence. All sequences having double strands or bases located at 3' of one strand may not have a base bond with an opposite (the other) sequence, which is referred to as a 3' overhang. That is, the perfect complementary sequence of miR-3670 is represented by SEQ ID NO. 36.

```
                                      (SEQ ID NO. 36)
5'-GAGAAGGACAGCUGUGAGCUCUUU-3'
```

In addition, the endogenous complementary sequence of miR-3670 may be represented by SEQ ID NO. 67.

```
                                      (SEQ ID NO. 67)
5'-GACUGGUAUAGCUGCUUUUGGAGCCUCA-3'
```

As described in the Background, the seed region corresponding from the $2^{nd}$ base to the $8^{th}$- $9^{th}$ bases of miRNA active sequences are major active factors, and long double strands containing the same may be produced and used upon the production of double stranded RNAs.

Like miR-3670, active sequences of miR-4477a and miR-8078 and complementary sequences that form double strands with the active sequences are represented as follows. As described above, these double strands may include a 3' overhang and may be double strands with a long sequence including the seed region.

```
miR-4477a
                      (MIMAT0019004 SEQ ID NO. 43)
5'-CUAUUAAGGACAUUUGUGAUUC-3'

Perfect complementary sequence of miR-4477a
                                      (SEQ ID NO. 44)
5'-AUCACAAAUGUCCUUAAUAGUU-3'

Endogenous complementary sequence of miR-4477a
                                      (SEQ ID NO. 68)
5'-AUCACAAAUGUCCUUAAUGGCA-3' miR-8078
                      (MIMAT0031005, SEQ ID NO. 65)
5'-GGUCUAGGCCCGGUGAGAGACUC
```

```
Perfect complementary sequence of miR-8078
                                      (SEQ ID NO. 66)
5'-GUCUCUCACCGGGCCUAGACCUU Endogenous complementary sequence of miR-8078
                                      (SEQ ID NO. 69)
5'-CUCCACCGGGCUGACCGGCCUG-3'
```

The miRNAs discovered through the library screening according to the present invention were found to provide anticancer efficacies by controlling genes commonly known to play a key role in the induction, production and growth of cancer. The feature of miRNAs is that one type of miRNA can simultaneously control expression of a plurality of mRNAs. This feature can be identified by the present invention as well and is useful for the development of oligo-based anti-cancer drugs.

Figure 6:
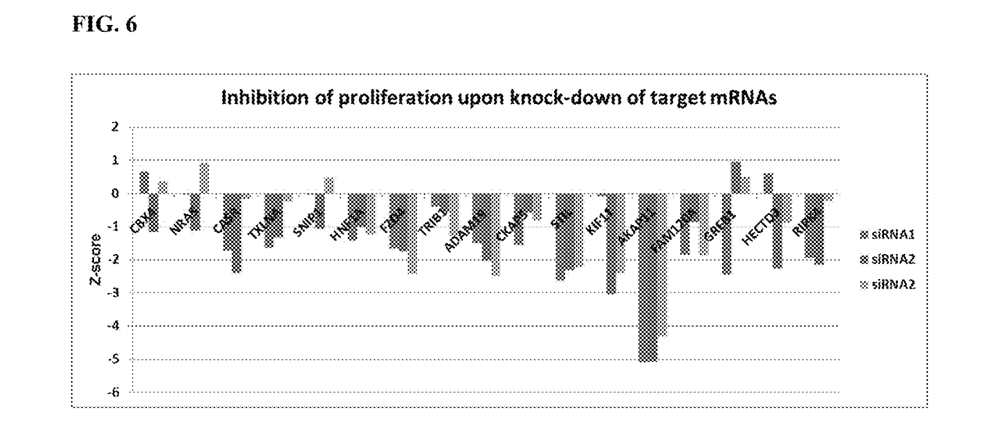
FIG. 6 shows cell death performance represented by Z-score when selecting target candidate groups using the miRNA target prediction software, TargetScan, and reducing the intracellular content using siRNAs targeting the target candidate groups.

The miR-3670 of the present invention simultaneously inhibits expressions of CBX4, NRAS, CASR, TXLNA, SNIP1, HNF1A, FZD4, TRIB1, ADMA19 and CKAP5, miR-8078 inhibits expressions of GREB1, HECTD3 and RIPK4, and miR-4477a simultaneously inhibits expressions of STIL, KIF11, AKAP11, and FAM120A (FIG. 6).

The target genes inhibited by miRNAs of the present invention are known to have the following functions.

CBX4 (polycomb chromobox 4) is involved in angiogenesis of tumors and facilitation of metastasis thereof, and NRAS is known to play a key role in tumor growth and cell division (Orouji, E. et al. MAP Kinase pathway gene copy alterations in NRAS/BRAF wild-type advanced melanoma. Int J Cancer (2015); Zheng, C. et al. MicroRNA-195 functions as a tumor suppressor by inhibiting CBX4 in hepatocellular carcinoma. Oncol Rep 33, 1115-22 (2015); Jiao, H. K. et al. Prognostic significance of Cbx4 expression and its beneficial effect for transarterial chemoembolization in hepatocellular carcinoma. Cell Death Dis 6, e1689 (2015); Ohashi, K. et al. Characteristics of lung cancers harboring NRAS mutations. Clin Cancer Res 19, 2584-(2013)).

CASR is found to be over-expressed in tumors and is required for metastasis of tumors, and TXLNA is known to be involved in the growth and metastasis of tumors. Clinical results have been reported that the survival rate of patients with high expression rates of TXLNA is low (Mashidori, T., Shirataki, H., Kamai, T., Nakamura, F. & Yoshida, K. Increased alpha-taxilin protein expression is associated with the metastatic and invasive potential of renal cell cancer. Biomed Res 32, 103-10 (2011); Tennakoon, S., Aggarwal, A. & Kallay, E. The calcium-sensing receptor and the hallmarks of cancer. Biochim Biophys Acta (2015); Ohtomo, N. et al. Expression of alpha-taxilin in hepatocellular carcinoma correlates with growth activity and malignant potential of the tumor. Int J Oncol 37, 1417-23 (2010)).

SNIP1, known as a transcriptional coactivator, promotes the expression of cyclin D1, which is essential for cell growth and division. It is known that the anticancer prognosis of patients with a high expression level of SNIP1 is bad. In addition, SNIP1 is known to function to promote tumor growth in combination with c-Myc, which acts as a major regulator of cell proliferation (Li, Q. et al. SNIP1: a new activator of HSE signaling pathway. Mol Cell Biochem 362, 1-6 (2012); Fujii, M. et al. SNIP1 is a candidate modifier of the transcriptional activity of c-Myc on E box-dependent target genes. Mol Cell 24, 771-83 (2006); Roche, K. C., Rocha, S., Bracken, C. P. & Perkins, N. D. Regulation of ATR-dependent pathways by the FHA domain containing protein SNIP1. Oncogene 26, 4523-30 (2007);

Jeon, H. S. et al. High expression of SNIP1 correlates with poor prognosis in non-small cell lung cancer and SNIP1 interferes with the recruitment of HDAC1 to RB in vitro. Lung Cancer 82, 24-30 (2013); Liang, X. et al. Hypoxia-inducible factor-1 alpha, in association with TWIST2 and SNIP1, is a critical prognostic factor in patients with tongue squamous cell carcinoma. Oral Oncol 47, 92-7 (2011)).

HNF1A and FZD4 are constituent factors of the Wnt signaling system that is deeply involved in the growth and survival of tumors. The Wnt signaling system has been intensively researched in tumor biology and its importance is widely known. TRIB1 is known to play a role in growth and metastasis of tumor cells and inhibition of cell apoptosis, and is known as a factor regulating the MAPK signaling system which is one of the main signaling pathways of tumor growth (Pecina-Slaus, N. et al. Wnt signaling transcription factors TCF-1 and LEF-1 are upregulated in malignant astrocytic brain tumors. Histol Histopathol 29, 1557-64 (2014); Ueno, K. et al. Tumor suppressor microRNA-493 decreases cell motility and migration ability in human bladder cancer cells by downregulating RhoC and FZD4. Mol Cancer Ther 11, 244-53 (2012); Lin, Z. Y. et al. MicroRNA-224 inhibits progression of human prostate cancer by downregulating TRIB1. Int J Cancer 135, 541-50 (2014); Soubeyrand, S., Naing, T., Martinuk, A. & McPherson, R. ERK1/2 regulates hepatocyte Trib1 in response to mitochondrial dysfunction. Biochim Biophys Acta 1833, 3405-14 (2013)).

ADAM19 is a protein distributed on the cell membrane, which is known to play diverse biological roles including cell-cell contact and cell-extracellular matrix contact. It is known in tumor biology that ADAM19 is strongly correlated with growth and metastasis of tumors. The CKAP5 gene, which is known to play a key role in the survival of tumors through functional genetic screens, is also controlled by the miRNA, which is identified by the present invention. GREB1, which is a gene related to signaling pathways of hormone-responsive tissues or tumors, is known to be overexpressed in various types of tumors to promote cell growth (Zhang, Q. et al. Role of microRNA-30c targeting ADAM19 in colorectal cancer. PLoS One 10, e0120698 (2015); Shan, N., Shen, L., Wang, J., He, D. & Duan, C. MiR-153 inhibits migration and invasion of human non-small-cell lung cancer by targeting ADAM19. Biochem Biophys Res Commun 456, 385-91 (2015); Martens-de Kemp, S. R. et al. Functional genetic screens identify genes essential for tumor cell survival in head and neck and lung cancer. Clin Cancer Res 19, 1994-2003 (2013); Rae, J. M. et al. GREB1 is a novel androgen-regulated gene required for prostate cancer growth. Prostate 66, 886-94 (2006); Zhang, L. et al. Development of transcriptomic biomarker signature in human saliva to detect lung cancer. Cell Mol Life Sci 69, 3341-50 (2012); Laviolette, L. A., Hodgkinson, K. M., Minhas, N., Perez-Iratxeta, C. & Vanderhyden, B. C. 17beta-estradiol upregulates GREB1 and accelerates ovarian tumor progression in vivo. Int J Cancer 135, 1072-84 (2014)).

HECTD3 is known as an E3 ubiquitin ligase that inhibits tumor death by inducing degradation of caspase-8 by attaching polyubiquitin to caspase-8 which facilitates cell apoptosis and increases drug resistance to cisplatin anticancer drugs by stabilizing MALT1 proteins. RIPK4 has been reported as receptor-interacting protein kinase 4 to induce accumulation of β-catenin, which is a cell growth signaling factor, and to activate the Wnt signaling system. It has been found that artificial elimination of RIPK4 can inhibit tumor growth in tumor animal models (Li, Y. et al. The HECTD3 E3 ubiquitin ligase facilitates cancer cell survival by promoting K63-linked polyubiquitination of caspase-8. Cell Death Dis 4, e935 (2013); Li, Y. et al. The HECTD3 E3 ubiquitin ligase suppresses cisplatin-induced apoptosis via stabilizing MALT1. Neoplasia 15, 39-48 (2013); Huang, X. et al. Phosphorylation of Dishevelled by protein kinase RIPK4 regulates Wnt signaling. Science 339, 1441-5 (2013)).

The STIL gene as an essential element in the transition from the G2 phase to the M phase during the cell cycle is observed to be highly expressed in various types of cancer and is known to be necessary for tumor proliferation and survival. KIF11 is also reported to be one of factors necessary for the growth and metastasis of tumor cells and is known to inhibit growth of tumors by inhibiting the activity of KIF11 (Erez, A. et al. Sil overexpression in lung cancer characterizes tumors with increased mitotic activity. Oncogene 23, 5371-7 (2004); Erez, A. et al. The SIL gene is essential for mitotic entry and survival of cancer cells. Cancer Res 67, 4022-7 (2007); Tang, Y., Orth, J. D., Xie, T. & Mitchison, T. J. Rapid induction of apoptosis during Kinesin-5 inhibitor-induced mitotic arrest in HL60 cells. Cancer Lett 310, 15-24 (2011); Venere, M. et al. The mitotic kinesin KIF11 is a driver of invasion, proliferation, and self-renewal in glioblastoma. Sci Transl Med 7, 304ra143 (2015)).

AKAP11, which binds to protein kinase A (PKA) to increase PKA activity, simultaneously binds to GSK-3beta as well to promote phosphorylation of GSK-3beta by PKA. Phosphorylated GSK-3beta loses its activity, which is recognized as a signal that stimulates growth in cells and is one of the major mechanisms leading to tumor growth. Tumor cells are exposed to a variety of stress conditions such as acidic conditions and oxygen deficiency conditions. Under these severe conditions, the mechanism of tumor cell death is maintained. Among them, FAM120A, which is an RNA binding protein, is known to activate a kinase such as Src, thereby increasing inhibition of cell death and resistance to drugs (Logue, J. S. et al. AKAP220 protein organizes signaling elements that impact cell migration. J Biol Chem 286, 39269-(2011); Whiting, J. L. et al. Protein Kinase A Opposes the Phosphorylation-dependent Recruitment of Glycogen Synthase Kinase 3beta to A-kinase Anchoring Protein 220. J Biol Chem 290, 19445-57 (2015); Tanji, C. et al. A-kinase anchoring protein AKAP220 binds to glycogen synthase kinase-3beta (GSK-3beta) and mediates protein kinase A-dependent inhibition of GSK-3beta. J Biol Chem 277, 36955-61 (2002); Tanaka, M. et al. A novel RNA-binding protein, Ossa/C9orf10, regulates activity of Src kinases to protect cells from oxidative stress-induced apoptosis. Mol Cell Biol 29, 402-13 (2009); Bartolome, R. A. et al. IL13 Receptor alpha2 Signaling Requires a Scaffold Protein, FAM120A, to Activate the FAK and PI3K Pathways in Colon Cancer Metastasis. Cancer Res 75, 2434-44 (2015)).

Figure 7:
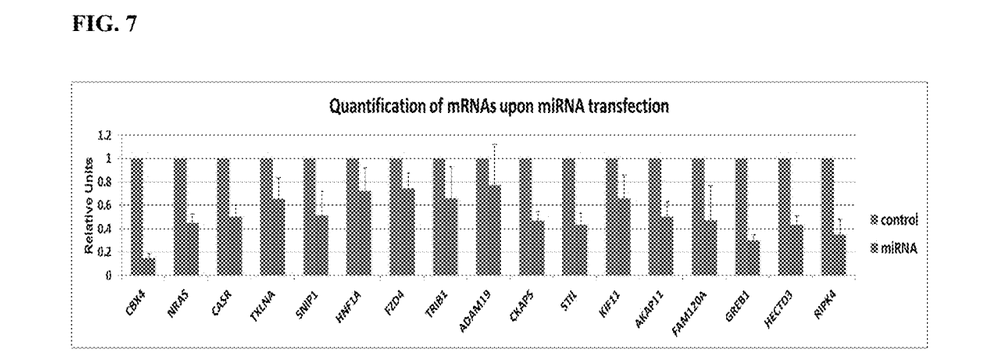
FIG. 7 shows results of qPCR analysis indicating the degree of inhibition of expression levels of genes identified in FIG. 6 by miRNA.
Figure 8:
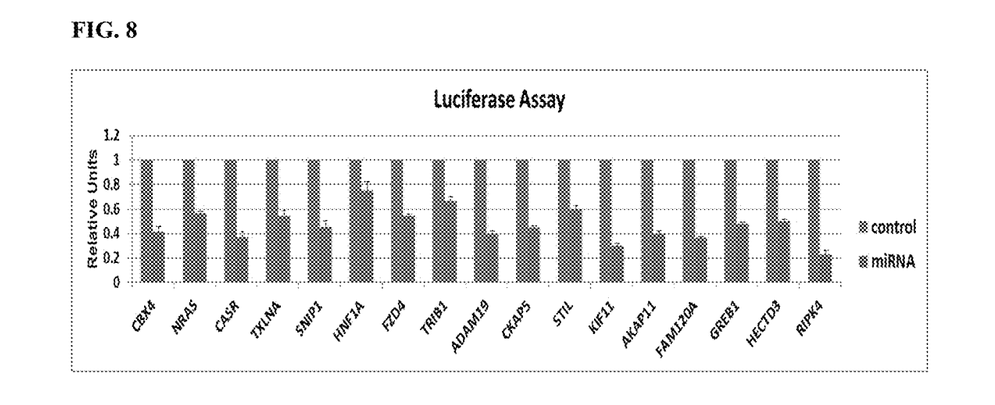
FIG. 8 shows the degree of inhibition against the expression of luciferase proteins by miRNAs by cloning the genes identified in FIG. 6 on the 3' UTR of luciferase.

It was identified by the present invention that, when contents of genes in cells were reduced using siRNAs, the growth of the cells was decreased as in the case of using miR-3670, miR4477a and miR-8078 (FIG. 6). qPCR results showed that, when miR-3670, miR-4477a and miR-8078 were delivered into lung cancer cells, the mRNA expression of the genes was decreased (FIG. 7). In addition, luciferase results identified that the genes were direct targets of miR-3670, miR-4477a and miR-8078 (FIG. 8). This indicates that miR-3670, miR-4477a and miR-8078 induce death of tumor cells by directly and simultaneously inhibiting the expression of several genes important for growth and survival of tumor cells.

Among the miRNAs, miR-3670 simultaneously inhibits expression of CBX4, NRAS, CASR, TXLNA, SNIP1, HNF1A, FZD4, TRIB1, ADMA19 and CKAPS, miR-8078 inhibits expression of GREB1, HECTD3 and RIPK4, and miR-4477a simultaneously inhibits expression of STIL, KIF11, AKAP11 and FAM120A. For this reason, the mRNAs of the genes include a perfect match wherein the corresponding miRNA regions are complementary 100% to base sequences, as well as mismatch wherein the corresponding miRNA regions are inconsistent with some base sequences. For these miRNAs, the match of the seed regions is the most important, and miRNAs preferably have at least 70%, more preferably at least 80%, even more preferably at least 90%, still even more preferably 95% or more, and most preferably 100%, of an identity with a part of mRNA sequences of the corresponding genes.

Such miRNAs may be duplexes, include single molecule polynucleotide, and be antisense oligonucleotides or microRNAs (miRNAs), but are not limited thereto.

With regard to the oligo conjugates, wherein hydrophilic and hydrophobic mateirals are bound to RNA oligos, according to the present invention, the conjugates, wherein hydrophilic and hydrophobic materials are bound to both ends of RNA oligos, can efficiently deliver RNA oligos in vivo and improve stability.

Self-assembled nanoparticles are formed through hydrophobic interactions of hydrophobic materials. These nanoparticles have extremely excellent in vivo delivery efficiency and in vivo stability, and the improvement in structures provides very uniform particle sizes and easy quality control (QC), thus having an advantage of simple drug manufacturing process.

In one embodiment, the hydrophilic material in the double-stranded oligo RNA structures comprising miRNAs according to the present invention is represented by $(A)_n$, $(A_m\text{-}J)_n$ or $(J\text{-}A_m)_n$, wherein A represents a hydrophilic material monomer, n represents 1 to 200, m represents 1 to 15, and J represents a linker that links m hydrophilic material monomers to one another, or links m hydrophilic material monomers to oligonucleotides.

When the hydrophilic substance is $(A)_n$, the double-stranded oligo RNA structure according to the present invention has the structure represented by the following Formula (1'):

[Formula (1')]

wherein A, B, X and Y are as defined in Formula (1), S represents a sense strand of specific miRNA regarding the corresponding gene and AS represents an antisense strand of specific miRNA regarding the corresponding gene.

In one embodiment, the double-stranded oligo RNA structure comprising miRNAs according to the present invention may be a double-stranded oligo RNA structure comprising the structure represented by the following Formula (2):

A-X-5'R3'Y-B [Formula (2)]

wherein A, B, X, Y and R are as defined in Formula (1).

More preferably, the double-stranded oligo RNA structure has a structure represented by the following Formula (2'):

[Formula (2')]

In one embodiment, the hydrophilic material may be a cationic or non-ionic polymer material having a molecular weight of 200 to 10,000, preferably a non-ionic polymer substance having a molecular weight of 1,000 to 2,000. As the hydrophilic material, a non-ionic hydrophilic polymer compound, for example, polyethylene glycol, polyvinylpyrrolidone or polyoxazoline is preferably used, but the present invention is not limited thereto.

In another embodiment, when the hydrophilic substance is $(Am\text{-}J)_n$ or $(J\text{-}A_m)_n$, the double-stranded oligo RNA structure according to the present invention has a structure represented by the following Formula (3) or Formula (4):

$(A_m\text{-}J)_n$-X-R-Y-B [Formula (3)]

$(J\text{-}A_m)_n$-X-R-Y-B [Formula (4)]

In Formula (3) and Formula (4), A represents a hydrophilic material monomer, n represents 1 to 200, represents 1 to 15, J represents a linker that links m hydrophilic material monomers to one another, or links m hydrophilic material monomer to oligonucleotide, X and Y each independently represent a simple covalent bond or a linker-mediated covalent bond, and R represents specific miRNA according to the present invention. More preferably, the double-stranded oligo RNA structure comprising miRNA according to the present invention may have a structure represented by Formula (3'):

$(A_m\text{-}J)_n$-X-S-Y-B

[Formula (3')]

wherein A, B, J, m, n, X and Y are as defined in Formula (3), S represents a sense strand of specific miRNA regarding the corresponding gene, and AS represents an antisense strand of specific miRNA regarding the corresponding gene.

More preferably, the double-stranded oligo RNA structure comprising miRNAs according to the present invention has a structure represented by the following Formula (4'):

$(J\text{-}A_m)_n$-X-S-Y-B AS [Formula (4')]

wherein A, B, J, m, n, X and Y are as defined in Formula (4), S represents a sense strand of specific miRNA regarding the corresponding gene, and AS represents an antisense strand of specific miRNA regarding the corresponding gene.

Any monomer of non-ionic hydrophilic polymers may be used as the hydrophilic material monomer (A) in Formula (3) and Formula (4) without particular limitation so long as it satisfies the objects of the present invention. Preferred is a monomer selected from Compounds (1) to (3) shown in Table 1, and more preferred is a monomer of Compound (1). Gin Compound (1) is preferably selected from $CH_2$, O, S and NH.

In particular, among the hydrophilic material monomers, the monomer represented by compound (1) has advantages of having a variety of functional groups which would be introduced, exhibiting excellent bio-compatibility, for example, providing better in vivo affinity and inducing less immune reactions, and improving in vivo stability and delivery efficiency of oligonucleotide contained in the structure according to Formula (3) and Formula (4), thus being very suitable for the manufacture of the structure according to the present invention.

TABLE 2

Preferred hydrophilic material monomer structures according to the present invention

| Compound (1) | Compound (2) | Compound (3) |
| --- | --- | --- |
|  G is $CH_2$, O, S or NH |  |  |

The hydrophilic material in Formula (3) and Formula (4) preferably has a total molecular weight of 1,000 to 2,000. Accordingly, for example, wherein hexaethylene glycol in Compound (1), that is, G is O, and m is 6, is used in Formula (3) and Formula (4), the molecular weight of the hexaethylene glycol spacer is 344 and thus the number of repeats (n) is preferably 3 to 5. According to the present invention, in Formula (3) and Formula (4), a repeat unit represented by $(A_m-J)$ or $(J-A_m)$, that is, a hydrophilic material block may be used as an appropriate number represented by "n". A, the hydrophilic material monomer and J, the linker, contained in each hydrophilic material block, may be independently identical or different between the hydrophilic material blocks. That is, when three hydrophilic material blocks are used (n=3), different hydrophilic material monomers may be used for all the hydrophilic material blocks, for example, the hydrophilic material monomer according to Compound (1) may be used for the first block, the hydrophilic material monomer according to Compound (2) may be used for the second block, and the hydrophilic material monomer according to Compound (3) may be used for the third block. Alternatively, any one hydrophilic material monomer selected from hydrophilic material monomers according to Compounds (1) to (3) may be used for all hydrophilic material blocks. Similarly, the linker, which mediates the bond between the hydrophilic material monomers, used for respective hydrophilic material blocks, may be identical or different. In addition, m, the number of the hydrophilic material monomers, may be identical or different for the respective hydrophilic material blocks. That is, different numbers of hydrophilic material monomers may be used, for example, for the first hydrophilic material block, three hydrophilic material monomers (m=3) are connected, for second hydrophilic material blocks, five hydrophilic material monomers (m=5) are connected, and for the third hydrophilic material block, four hydrophilic material monomers (m=4) are connected. Alternatively, the same number of hydrophilic material monomers may be used for all hydrophilic material blocks.

According to the present invention, the linker (J) is preferably selected from the group consisting of $PO_3^-$, $SO_3$ and $CO_2$, but is not limited thereto. Depending on the monomer of the used hydrophilic material or the like, any linker may be used so long as it satisfies the object of the present invention and is obvious to those skilled in the art.

The entirety or part of the hydrophilic material monomer may be modified to have a functional group required for bonding to other substances such as a target specific ligand.

In some cases, one to three phosphate groups may be bonded to the 5' end of the antisense strand of a double-stranded oligo RNA structure comprising specific miRNA for the gene.

For example, the double-stranded oligo RNA structure comprising miRNA has a structure represented by the following Formula (3") or Formula (4"):

$(A_m-J)_n$-X-5'S3'-Y-B

3'AS5'-$PO_4$                          [Formula (3")]

$(J-A_m)_n$-X-5'S3'-Y-B

3'AS5'-$PO_4$                          [Formula (4")]

The hydrophobic material (B) functions to form nanoparticles having an oligonucleotide structure represented by Formula (1) through hydrophobic interaction.

The hydrophobic material preferably has a molecular weight of 250 to 1,000, and may be a steroid derivative, a glyceride derivative, glycerol ether, polypropylene glycol, $C_{12}$ to $C_{50}$ unsaturated or saturated hydrocarbon, diacylphosphatidylcholine, fatty acid, phospholipid, lipopolyamine or the like, but is not limited thereto. Any hydrophobic material may be used without limitation so long as it satisfies the objects of the present invention, which is obvious to those skilled in the art to which the present invention pertains.

The steroid derivative may be selected from the group consisting of cholesterol, cholestanol, cholic acid, cholesteryl formate, cholestanyl formate and cholestanylamine, and the glyceride derivative may be selected from mono-, di- and tri-glyceride and the like, wherein the fatty acid of glyceride is preferably a $C_{12}$ to $C_{50}$ unsaturated or saturated fatty acid.

In particular, among the hydrophobic materials, saturated or unsaturated hydrocarbon or cholesterol is preferred for easy binding to oligonucleotide during synthesis of the oligonucleotide structures according to the present invention.

The hydrophobic material is bonded to the distal end of the hydrophilic material and may be bonded to the sense strand or antisense strand of miRNAs.

According to the present invention, the hydrophilic material, the hydrophilic material block or the hydrophobic material is bonded to oligonucleotide through a simple covalent bond or linker-mediated covalent bond (X or Y). The covalent bond may be a non-degradable or degradable bond. Examples of the non-degradable bond include an amide bond or a phosphoryl bond, and the degradable bond includes a disulfide bond, an acid-degradable bond, an ester bond, an anhydride bond, a biodegradable bond, an enzyme-degradable bond or the like, but is not limited thereto.

Figure 9A:
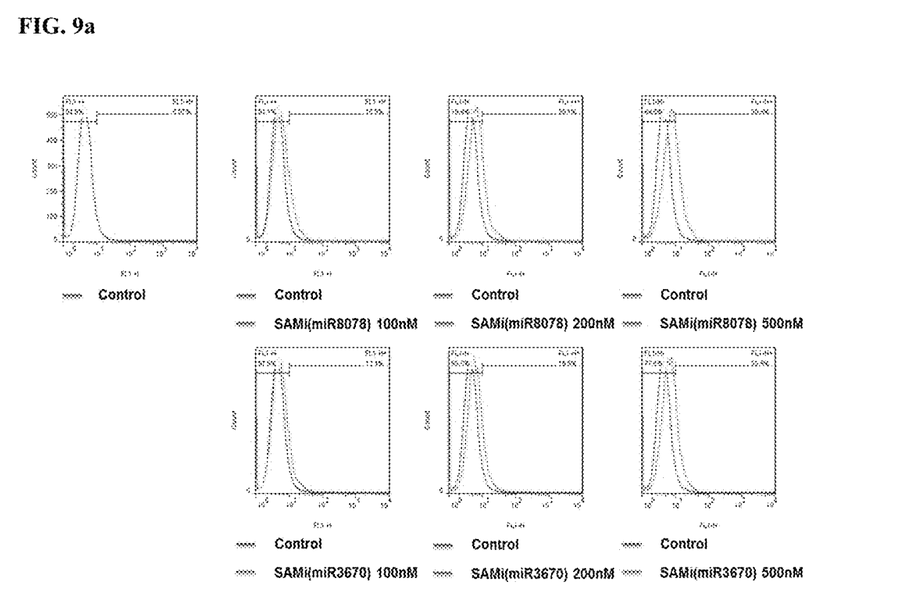
FIGS. 9A and 9B are images showing comparison in induction of apoptosis mechanisms, when treating lung cancer cell lines with an oligo RNA structure containing a miRNA sequence, and then staining with Annexin V.
Figure 9B:
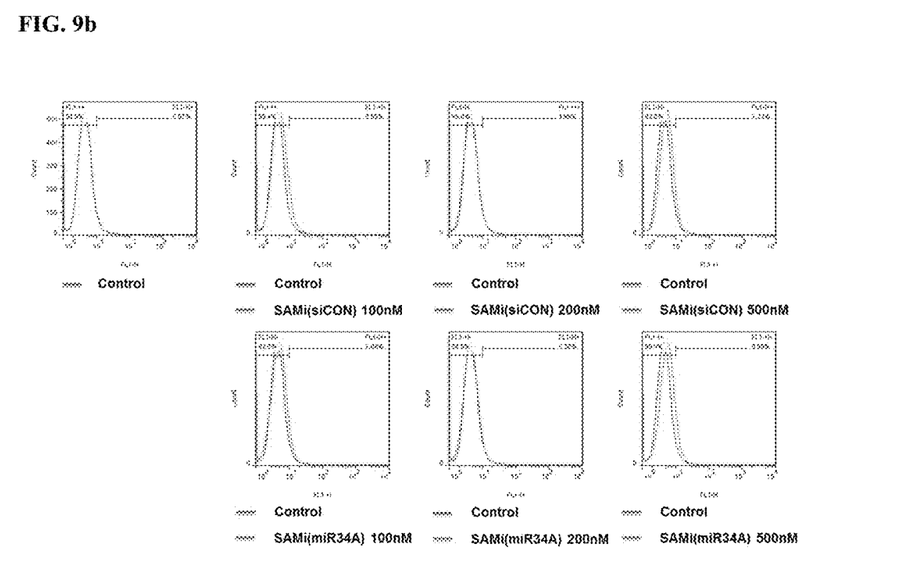

The miRNA oligo structures according to the present invention were produced and in vitro treated with lung cancer cell lines, and the cell lines were stained with Annexin V and were analyzed by flow cytometry. As can be seen from FIGS. 9A and 9B, when nanoparticles were used to improve in vivo stability using the RNA structure, apoptosis of cell lines can be concentration-dependently induced.

Based on this, the present invention relates to a composition for preventing or treating cancer comprising the oligonucleotide structure. The present invention also relates to a method for preventing or treating cancer comprising a step of administering the oligonucleotide structure.

According to the present invention, the cancer is at least one selected from the group consisting of primary cancer such as lung cancer, liver cancer, stomach cancer, colon cancer, pancreatic cancer, gall bladder cancer, biliary tract cancer, breast cancer, leukemia, esophageal cancer, non-Hodgkin's lymphoma, thyroid cancer, cervical cancer and skin cancer, and metastatic cancer caused by metastasis from primary cancer to other organs, and tumor-associated cell diseases caused by promotion of abnormal excessive cell division, but the present invention is not limited thereto.

The miRNA sequence that can be used as an active ingredient of the composition for treating cancer provided by the present invention is a sequence derived from the human genome, however, a miRNA sequence obtained from the genome derived from another animal also can be used without limiting the genome of the miRNA The miRNA can be used in the form of various miRNA derivatives (miRNA mimics) that generate the bioequivalence efficacy of miRNAs, and can be modified miRNAs containing miRNA sequences containing the same seed region. At this time, the length of sequence 1 or sequence 2 can be reduced, and a short derivative consisting of 15 nucleotides can also be used.

The miRNA derivatives for miRNAs may partially include a phosphorothiolate structure in which O in the RNA phosphate backbone structure is replaced with another element such as sulfur, and can be used in the forms wherein DNA, PNA (peptide nucleic acid) and LNA (locked nucleic acid) molecules are entirely or partially replaced with RNA and can be used in the forms wherein the 2' hydroxyl group of RNA sugar is replaced with various functional structures, and examples of such modifications include, but are not limited to, methylation, methoxylation, fluorination and the like.

The miRNA is not limited to mature miRNA and the double stranded RNA of the miRNA derivative derived therefrom, and can be used in the form of a miRNA precursor and, for the miRNA precursor, aforementioned partial or entire replacement of the RNA phosphate backbone structure and RNA nucleic acid with DNA, PNA, LNA and the like, and modification of the 2' hydroxyl group of the RNA sugar molecule are possible.

The miRNA can be used in the form of precursor miRNA or primary miRNA (pri-miRNA) and can be synthesized by a chemical method or delivered in the form of a plasmid to cells which express the same.

According to the present invention, methods for delivering miRNAs to cells cultured on culture dishes include, but are not limited to, mixing with cationic lipids, using electrical stimulation, and using viruses.

The composition for treating cancer comprising the miRNA as an active ingredient may be a pharmaceutical composition further containing a pharmaceutically acceptable carrier and may be formulated together with a carrier.

The term "pharmaceutically acceptable carrier" as used herein refers to a carrier or diluent that does not impair biological activities or properties of an administered compound without stimulating an organism. Acceptable pharmaceutical carriers for compositions, which are formulated into liquid solutions, are sterilized and biocompatible and examples thereof include saline, sterile water, Ringer's solution, buffered saline, albumin injection solutions, dextrose solutions, maltodextrin solutions, glycerol, ethanol and mixtures thereof. If necessary, other conventional additives such as antioxidants, buffers and bacteriostatic agents may be added. In addition, diluents, dispersants, surfactants, binders and lubricants can be additionally added to formulate injectable solutions such as aqueous solutions, suspensions and emulsions, pills, capsules, granules or tablets.

The composition for preventing or treating cancer comprising the miRNA and the pharmaceutically acceptable carrier can be applied to any formulation containing the same as an active ingredient and can be prepared for oral or parenteral formulation. The pharmaceutical formulation may include formulations suitable for oral, rectal, nasal, topical (including under the cheek and tongue), subcutaneous, vaginal or parenteral (including intramuscular, subcutaneous and intravenous) administration, or inhalation or insufflation. Examples of formulations for oral administration containing the composition of the present invention as an active ingredient include tablets, troches, lozenges, aqueous or oily suspensions, prepared powders or granules, emulsions, hard or soft capsules, syrups or elixirs. In order to prepare formulations such as tablets and capsules, a binder such as lactose, saccharose, sorbitol, mannitol, starch, amylopectin, cellulose or gelatin, an excipient such as dicalcium phosphate, a disintegrating agent such as corn starch or sweet potato starch, a lubricant such as calcium stearate, sodium stearyl fumarate or polyethyleneglycol wax can be incorporated, and capsule formulations may further contain a liquid carrier such as a fatty oil, in addition to the above-mentioned ingredients.

Examples of the formulations for parenteral administration containing the composition of the present invention as an active ingredient include injection forms such as subcutaneous injection, intravenous injection or intramuscular injection, suppository or spray forms such as aerosols inhalable through a breathing apparatus. For preparation into injectable formulations, the compositions of the present invention can be mixed in water with stabilizers or buffers to prepare solutions or suspensions and the solutions or suspensions can be formulated on the basis of an ampule or vial unit for administration. For suppository injection, compositions for rectal administration such as suppositories containing a conventional suppository base such as cocoa butter or other glycerides or enema preparations can be formulated. For spray formulation such as an aerosol, an additive such as a propellant may be mixed such that a water-dispersed concentrate or wet powder is dispersed.

Hereinafter, the present invention will be described in more detail with reference to examples. However, it is obvious to those skilled in the art that these examples are provided only for illustration of the present invention and should not be construed as limiting the scope of the present invention.

EXAMPLE 1 PRODUCTION OF miRNA SCREENING LIBRARY

As 21-version human miRNA sequences provided from the miRNA database, miRBase (www.mirbase.org), double-stranded sequences of miRNA were synthesized by a solid synthesis method used for common synthesis of oligo from 1,700 miRNA screening libraries, based on the stem-loop structure. Each strand of the synthesized miRNA was purified by reverse phase separation using a C18 resin. Whether or not the intended sequence was synthesized for all synthesized miRNA strands was detected and identified with a MALDI-TOF mass spectrometer. In order to prepare double-stranded miRNAs, the synthesized miRNA strands and the corresponding complementary strands were heated in the presence of a salt at 95° C. for 2 minutes and then slowly cooled. Sequences 1 of respective tested double-stranded miRNAs are represented by SEQ ID NO. 70 to SEQ ID NO. 1797 in this order and Sequences 2 thereof are represented by SEQ ID NO. 1798 to 3525 in this order.

EXAMPLE 2 MEASUREMENT OF ACTIVITY OF miRNA LIBRARY SAMPLES

Figure 1:
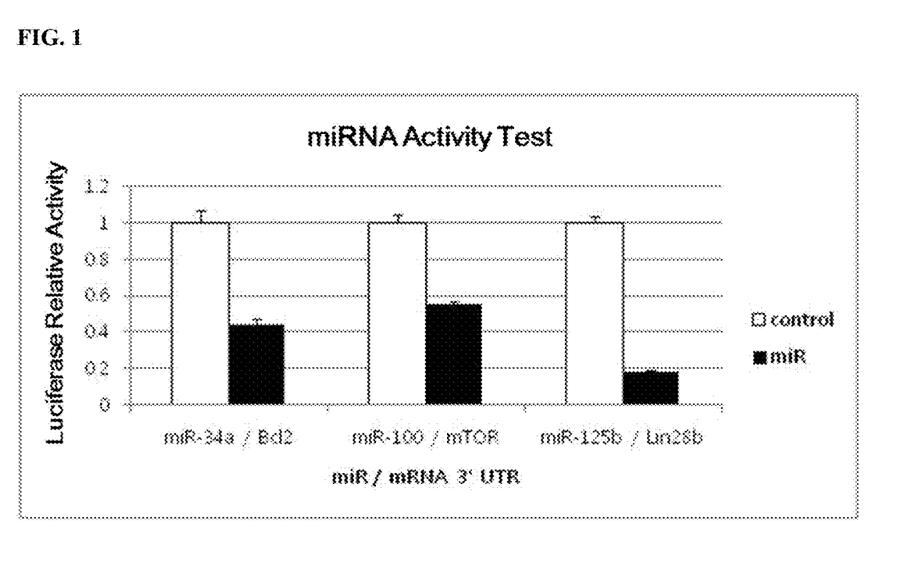
FIG. 1 is a graph showing test results regarding inhibitory activities against protein expression by miR-34a, miR-100 and miR-125b, which are representatively selected from the entire screening library, and each mRNA 3' UTR whose expression is known to be inhibited by miR-34a, miR-100 and miR-125b is inserted into the 3' UTR of the luciferase expression vector, in order to identify the activity of the miRNAs.

In order to identify whether or not miRNA double strands synthesized in Example 1 were active, miR-34a, miR-100 and miR-125b were selectively selected from about 1,700 types of miRNA screening libraries. miRNAs have been selected based on the large number of studies previously performed on the types of target mRNAs that control functions and expression and the binding sites that bind to each mRNA 3' UTR. The 3' UTR sites of Bcl2, mTOR and Lin28b mRNAs, which are known to be regulated by miR-34a, miR-100 and miR-125b, respectively, are replaced with the 3' UTR sites of the firefly luciferase vector to produce vectors corresponding to respective miRNAs. The HEK-293T cell lines were co-transfected with each vector and miR control group, or miR-34a, miR-100 and miR-125b corresponding to each vector, using an intracellular delivery reagent of oligo, Lipofectamine 2000 (Invitrogen) (three replicate samples) and cultured at 37° C. and 5% (v/v) carbon dioxide for 24 hours. The activity of luciferase was measured using a luminometer (Thermo Scientific) to identify the activity of the synthesized miRNA (FIG. 1).

Figure 2:
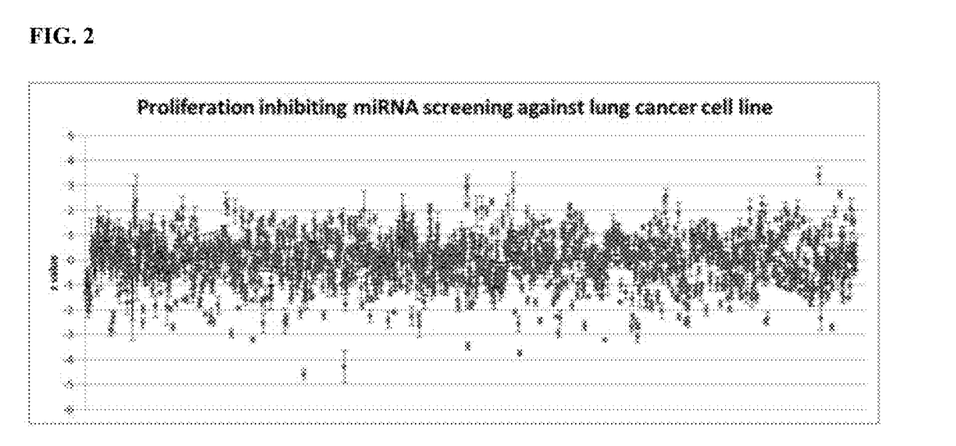
FIG. 2 is a graph showing results, when treating NCI-H460 lung cancer cell lines with a screening library composed of 1,700 kinds of miRNAs, quantifying cell growth using Resazurin reagent and then converting the resulting value into a relative growth value.

EXAMPLE 3 SCREENING FOR IDENTIFYING MICRO RNAs INDUCING INHIBITION OF PROLIFERATION OF LUNG CANCER CELL LINES 3,000 to 10,000 NCI-H460 cells were seeded on a 96-well plate and cultured at 37° C., and 5% (v/v) carbon dioxide for 24 hours. Each miRNA of the miRNA library was transfected using RNAiMAX reagent (Invitrogen) to a final concentration of 100 nM. Each miRNA was transfected three times, which means that three 96-well plates for each miRNA library stored on a 96-well plate were prepared. The cells were further cultured for 24 hours under the same conditions as the cell culture conditions described above, and the fluorescence value generated by adding Resazurin reagent (Promega) was measured using a fluorescence meter (Fluoremeter, Tecan). In order to comparatively evaluate the ability of each miRNA to inhibit cell proliferation, a mean value and a standard deviation of 96 values measured on the 96-well plate were determined. The difference according to standard deviation multiple between the measured value in each miRNA-containing well and the mean value was calculated in accordance with the following (Z-score) formula:

$$z_i = \frac{x_i - \mu}{\sigma}$$

wherein $x_i$ is the measured value of each well, $\mu$ is the mean value of the whole well of the plate, and $\sigma$ is the standard deviation. The standard deviation multiple, $z_i$, of each well was the mean value obtained from the three plate replicates, and was used to select 50 primary candidate miRNAs having a z value less than −2 (FIG. 2, Table 2).

TABLE 2

Primarily-screened miRNA sequences

| | | |
|---|---|---|
| SEQ ID NO. 1 hsa-miR-23c | strand 1 | AUCACAUUGCCAGUGAUUACCC |
| SEQ ID NO. 2 hsa-miR-23c | strand 2 | GUAAUCACUGGCAAUGUGAUUU |
| SEQ ID NO. 3 hsa-miR-219b | strand 1 | AGAUGUCCAGCCACAAUUCUCG |
| SEQ ID NO. 4 hsa-miR-219b | strand 2 | AGAAUUGCGUUUGGACAAUCAGU |
| SEQ ID NO. 5 hsa-miR-378c | strand 1 | ACUGGACUUGGAGUCAGAAGAGUGG |
| SEQ ID NO. 6 hsa-miR-378c | strand 2 | ACUCUUCUGACUCCAAGUCCAGUUU |
| SEQ ID NO. 7 hsa-miR-548aa | strand 1 | AAAAACCACAAUUACUUUUGCACCA |
| SEQ ID NO. 8 hsa-miR-548aa | strand 2 | GUGCAAAAGUAAUUGUGGUUUUUUU |
| SEQ ID NO. 9 hsa-miR-548u | strand 1 | CAAAGACUGCAAUUACUUUUGCG |
| SEQ ID NO. 10 hsa-miR-548u | strand 2 | CAAAAGUAAUUGCAGUCUUUGUU |
| SEQ ID NO. 11 hsa-miR-571 | strand 1 | UGAGUUGGCCAUCUGAGUGAG |
| SEQ ID NO. 12 hsa-miR-571 | strand 2 | CACUCAGAUGGCCAACUCAUU |
| SEQ ID NO. 13 hsa-miR-641 | strand 1 | AAAGACAUAGGAUAGAGUCACCUC |
| SEQ ID NO. 14 hsa-miR-641 | strand 2 | GGUGACUCUAUCCUAUGUCUUUUU |
| SEQ ID NO. 15 hsa-miR-1244 | strand 1 | AAGUAGUUGGUUUGUAUGAGAUGGUU |
| SEQ ID NO. 16 hsa-miR-1244 | strand 2 | CCAUCUCAUACAAACCAACUACUUUU |
| SEQ ID NO. 17 hsa-miR-1248 | strand 1 | ACCUUCUUGUAUAAGCACUGUGCUAAA |
| SEQ ID NO. 18 hsa-miR-1248 | strand 2 | UAGCACAGUGCUUAUACAAGAAGGUUU |
| SEQ ID NO. 19 hsa-miR-1298 | strand 1 | CAUCUGGGCAACUGACUGAAC |
| SEQ ID NO. 20 hsa-miR-1298 | strand 2 | UUCAUUCGGCUGUCCAGAUGUA |
| SEQ ID NO. 21 hsa-miR-2392 | strand 1 | UAGGAUGGGGGUGAGAGGUG |
| SEQ ID NO. 22 hsa-miR-2392 | strand 2 | CCUCUCACCCCCAUCCUAUU |

TABLE 2-continued

Primarily-screened miRNA sequences

| SEQ ID NO. 23 | hsa-miR-3119 | strand 1 | UGGCUUUUAACUUUGAUGGC |
| SEQ ID NO. 24 | hsa-miR-3119 | strand 2 | CAUCAAAGUUAAAAGCCAUU |
| SEQ ID NO. 25 | hsa-miR-3164 | strand 1 | UGUGACUUUAAGGGAAAUGGCG |
| SEQ ID NO. 26 | hsa-miR-3164 | strand 2 | CCAUUUCCCUUAAAGUCACAUU |
| SEQ ID NO. 27 | hsa-miR-3188 | strand 1 | AGAGGCUUUGUGCGGAUACGGGG |
| SEQ ID NO. 28 | hsa-miR-3188 | strand 2 | CCGUAUCCGCACAAAGCCUCUUU |
| SEQ ID NO. 29 | hsa-miR-3609 | strand 1 | CAAAGUGAUGAGUAAUACUGGCUG |
| SEQ ID NO. 30 | hsa-miR-3609 | strand 2 | GCCAGUAUUACUCAUCACUUUGUU |
| SEQ ID NO. 31 | hsa-miR-3612 | strand 1 | AGGAGGCAUCUUGAGAAAUGGA |
| SEQ ID NO. 32 | hsa-miR-3612 | strand 2 | CAUUUCUCAAGAUGCCUCCUUU |
| SEQ ID NO. 33 | hsa-miR-3662 | strand 1 | GAAAAUGAUGAGUAGUGACUGAUG |
| SEQ ID NO. 34 | hsa-miR-3662 | strand 2 | UCAGUCACUACUCAUCAUUUUCUU |
| SEQ ID NO. 35 | hsa-miR-3670 | strand 1 | AGAGCUCACAGCUGUCCUUCUCUA |
| SEQ ID NO. 36 | hsa-miR-3670 | strand 2 | GAGAAGGACAGCUGUGAGCUCUUU |
| SEQ ID NO. 37 | hsa-miR-3943 | strand 1 | UAGCCCCCAGGCUUCACUUGGCG |
| SEQ ID NO. 38 | hsa-miR-3943 | strand 2 | CCAAGUGAAGCCUGGGGGCUAUU |
| SEQ ID NO. 39 | hsa-miR-4424 | strand 1 | AGAGUUAACUCAAAAUGGACUA |
| SEQ ID NO. 40 | hsa-miR-4424 | strand 2 | GUCCAUUUUGAGUUAACUCUUU |
| SEQ ID NO. 41 | hsa-miR-4461 | strand 1 | GAUUGAGACUAGUAGGGCUAGGC |
| SEQ ID NO. 42 | hsa-miR-4461 | strand 2 | CUAGCCCUACUAGUCUCAAUCUU |
| SEQ ID NO. 43 | hsa-miR-4477a | strand 1 | CUAUUAAGGACAUUUGUGAUUC |
| SEQ ID NO. 44 | hsa-miR-4477a | strand 2 | AUCACAAAUGUCCUUAAUAGUU |
| SEQ ID NO. 45 | hsa-miR-4477b | strand 1 | AUUAAGGACAUUUGUGAUUGAU |
| SEQ ID NO. 46 | hsa-miR-4477b | strand 2 | CAAUCACAAAUGUCCUUAAUUUU |
| SEQ ID NO. 47 | hsa-miR-4765 | strand 1 | UGAGUGAUUGAUAGCUAUGUUC |
| SEQ ID NO. 48 | hsa-miR-4765 | strand 2 | ACAUAGCUAUCAAUCACUCAUU |
| SEQ ID NO. 49 | hsa-miR-4773 | strand 1 | CAGAACAGGAGCAUAGAAAGGC |
| SEQ ID NO. 50 | hsa-miR-4773 | strand 2 | CUUUCUAUGCUCCUGUUCUGUU |
| SEQ ID NO. 51 | hsa-miR-4776 | strand 1 | GUGGACCAGGAUGGCAAGGGCU |
| SEQ ID NO. 52 | hsa-miR-4776 | strand 2 | CUUGCCAUCCUGGUCCACUGCAU |
| SEQ ID NO. 53 | hsa-miR-4999 | strand 1 | UGCUGUAUUGUCAGGUAGUGA |
| SEQ ID NO. 54 | hsa-miR-4999 | strand 2 | UCACUACCUGACAAUACAGU |
| SEQ ID NO. 55 | hsa-miR-5096 | strand 1 | GUUUCACCAUGUUGGUCAGGC |
| SEQ ID NO. 56 | hsa-miR-5096 | strand 2 | CUGACCAACAUGGUGAAACUU |
| SEQ ID NO. 57 | hsa-miR-5697 | strand 1 | UCAAGUAGUUUCAUGAUAAAGG |
| SEQ ID NO. 58 | hsa-miR-5697 | strand 2 | UUUAUCAUGAAACUACUUGAUU |
| SEQ ID NO. 59 | hsa-miR-5705 | strand 1 | UGUUUCGGGGCUCAUGGCCUGUG |
| SEQ ID NO. 60 | hsa-miR-5705 | strand 2 | CAGGCCAUGAGCCCCGAAACAUU |
| SEQ ID NO. 61 | hsa-miR-5707 | strand 1 | ACGUUUGAAUGCUGUACAAGGC |

TABLE 2-continued

Primarily-screened miRNA sequences

| | | | |
|---|---|---|---|
| SEQ ID NO. 62 | hsa-miR-5707 | strand 2 | CUUGUACAGCAUUCAAACGUUU |
| SEQ ID NO. 63 | hsa-miR-8053 | strand 1 | UGGCGAUUUUGGAACUCAAUGGCA |
| SEQ ID NO. 64 | hsa-miR-8053 | strand 2 | CCAUUGAGUUCCAAAAUCGCCAUU |
| SEQ ID NO. 65 | hsa-miR-8078 | strand 1 | GGUCUAGGCCCGGUGAGAGACUC |
| SEQ ID NO. 66 | hsa-miR-8078 | strand 2 | GUCUCUCACCGGGCCUAGACCUU |

EXAMPLE 4 SECONDARY SCREENING FOR IDENTIFYING MICRO RNAs WITH INHIBITORY ACTIVITY AGAINST PROLIFERATION OF LUNG CANCER CELL LINES

Figure 3:
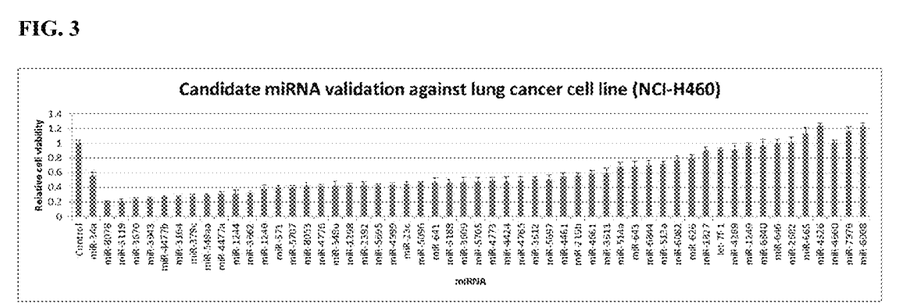
FIG. 3 is a graph showing results when selecting about 50 kinds of miRNAs showing excellent efficacy in NCI-H460 cell lines and measuring relative inhibitory activity against cancer cell growth with WST-1 reagent using the miRNAs.

Secondary screening was carried out by improving the measurement accuracy using 50 miRNA candidates group obtained by primary screening. The test conditions were the same as the primary screening conditions, except that WST-1 reagent (Roche) was used as a reagent for measuring cell proliferation ability, instead of resazurin. WST-1 was used because of the advantage of the capability of measuring the intensity of signal more quantitatively than resazurin. Measured values of cell inhibitory ability by each miRNA are shown relative to the control in FIG. 3, and miR-34a was also included as a positive control.

EXAMPLE 5 ANALYSIS OF CAPABILITY TO INDUCE CELL APOPTOSIS

Figure 4:
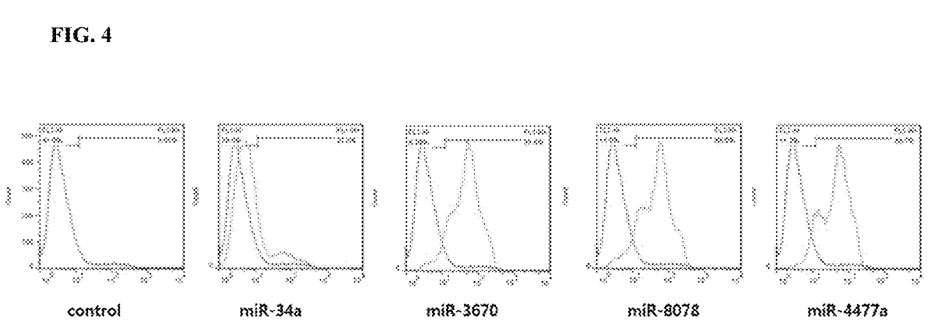
FIG. 4 shows results, when injecting miR-34a, miR-3670, miR-8078 and miR-4477a by transfection into cells in order to measure apoptotic effects in lung cancer cell lines, staining Annexin V labeled with FITC dye and then analyzing the degree of cell death with a flow cytometer.

The method used for screening is to measure the degree of relative inhibition of cell proliferation by measuring the number of cells in a quantitative sense. The mechanisms that inhibit cell proliferation include a method of reducing the cell cycle rate and a method of inducing apoptosis. In order to analyze the mechanisms of inhibitory activity of miRNAs found in the present invention against cell proliferation, the degree of apoptosis was analyzed by flow cytometry (fluorescence activated cell sorter (FACS)). For this purpose, cells were seeded on a 6-well plate, and the miRNA was injected into the cells using RNAiMAX reagent. Then, cells were cultured under the conditions described above for 48 hours. Then, the cells were treated with annexin V labeled with FIT-C fluorescent dye and analyzed by flow cytometry (FIG. 4). Analysis results showed that most of the cells treated with miR-3670, miR-4477a and miR-8078 were killed. This indicates that inhibition of tumor growth of the miRNA identified in the screening is caused by inducing apoptosis (Table 3).

TABLE 3

Finally-screened miRNA sequences

| | | | |
|---|---|---|---|
| SEQ ID NO. 35 | hsa-miR-3670 | strand 1 | AGAGCUCACAGCUGUCCUUCUCUA |
| SEQ ID NO. 36 | hsa-miR-3670 | strand 2 | GAGAAGGACAGCUGUGAGCUCUUU |
| SEQ ID NO. 67 | miR-IC | IC | GACUGGUAUAGCUGCUUUUGGAGCCUCA |
| SEQ ID NO. 43 | hsa-miR-4477a | strand 1 | CUAUUAAGGACAUUUGUGAUUC |
| SEQ ID NO. 44 | hsa-miR-4477a | strand 2 | AUCACAAAUGUCCUUAAUAGUU |
| SEQ ID NO. 68 | miR-4477a-IC | IC | AUCACAAAUGUCCUUAAUGGCA |
| SEQ ID NO. 65 | hsa-miR-8078 | strand 1 | GGUCUAGGCCCGGUGAGAGACUC |
| SEQ ID NO. 66 | hsa-miR-8078 | strand 2 | GUCUCUCACCGGGCCUAGACCUU |
| SEQ ID NO. 69 | miR-IC | IC | CUCCACCGGGCUGACCGGCCUG |

EXAMPLE 6 INHIBITION OF TUMOR GROWTH IN SOFT AGAR BY miRNA

Figure 5:
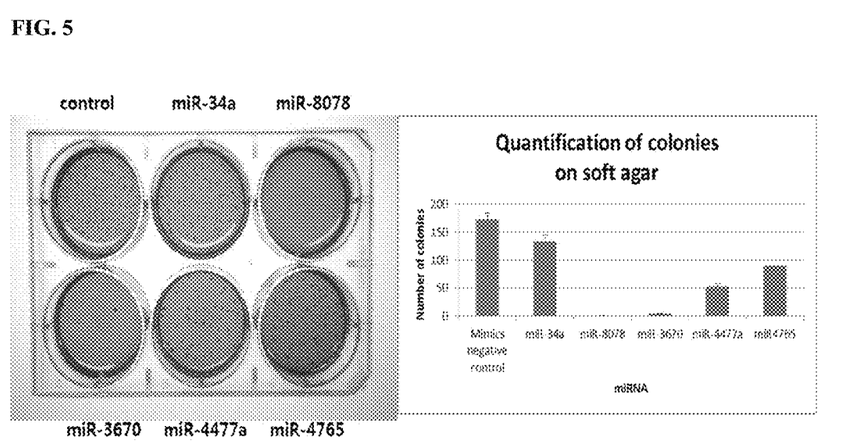
FIG. 5 shows measurement results regarding effects of miRNAs on clustering ability of lung cancer cell lines, after injecting each miRNA by transfection into lung cancer cell lines and culturing in soft agar for 2 weeks.

By culturing tumor cells using soft agar, the characteristics of the tumor cells can be measured. Normal cells require a support such as a culture dish to grow, whereas tumor cells tend to grow under an environment free from a physically rigid support such as soft agar. Cell clustering ability in soft agar was determined using these tumor specific properties. NCI-H460 lung cancer cell lines were treated with control miRNA, miR-34a, miR-8078, miR-3670, miR-4477a and miR-4765, cultured for 24 hours, mixed with soft agar, and cultured on a 6 well-plate for 2 weeks. The cells were stained with a crystal violet dye and the numbers of clusters were counted (FIG. 5). Results showed that the cells treated with miR-8078 and miR-3670 formed almost no clusters, and that the cells treated with miR-4477a showed about 30% of cluster formation ability as compared with the control.

EXAMPLE 7 MEASUREMENT OF INHIBITORY ACTIVITY OF miRNAs TARGET mRNAs AGAINST CELL PROLIFERATION

Target mRNAs, whose protein expression is controlled by miRNA, have a sequence partially complementary to the sequence of the miRNAs. In order to inhibit expression of mRNAs, the sequence of the seed region for miRNAs is particularly important, because it binds to mRNA having a sequence complementary to the seed region sequence to inhibit gene expression. However, because the seed region sequence is relatively short, i.e., 8 to 9 bases, the mRNA targeted by the miRNA is estimated using software. However, even when software is used, it is known that only some of the estimated targets are actual targets. In order to solve this difficulty, the target genes predicted through software were treated with siRNA to reduce intracellular content and were selected by determining whether or not cell growth was inhibited. TargetScan was used as a target prediction software generally used in the art in order to predict the target mRNA of miRNA, and the total 600 types of genes were selected as estimated targets of miR-3670, miR-4477a and miR-8078. Three siRNAs were synthesized for each gene selected, and the same experiment was conducted as in Example 3 using the siRNAs. Cells were seeded on 96-well plates, treated with each siRNA and cultured for 48 hours, and then cell proliferation was measured using a resazurin reagent. The Z-score of each gene was calculated from the mean of the measurement values of a total of about 1,800 (600 genes×3 kinds of siRNAs) in the same manner as in Example 3 and shown in FIG. 6.

EXAMPLE 8 ANALYSIS OF TARGET mRNA OF miRNA

The action mode of miRNAs deteriorates production of proteins from mRNAs and, at the same time, causes the degradation of most of the target mRNAs. Accordingly, miRNAs are injected into cells and the contents of mRNAs, which are the targets of miRNAs, are analyzed using qPCR, and the decrease in the content is measured, which can be used as a criterion for determining the target mRNA of miRNAs. In order to determine whether the target mRNAs were substantially degraded, when the miRNAs were transferred into cells, while targeting the target genes of miRNAs identified in Example 7, miR-3677, miR-4477a and miR-8078 were transfected into lung cancer cell line and then cultured for 48 hours, and RNAs were extracted from respective cells to quantitatively measure RNA contents (FIG. 7). Results showed that the predicted target mRNA contents of miR-3670, miR-4477a and miR-8078 were remarkably lowered.

EXAMPLE 9 IDENTIFICATION OF TARGET mRNAs BY LUCIFERASE ASSAY

Because miRNAs inhibit production of proteins from target mRNAs by binding to the 3' UTR (untranslated region) of target mRNAs, luciferase assay is commonly used as a method for directly measuring the relationships between miRNAs and target mRNAs. The TargetScan software provides the 3' UTR sequence containing the miRNA-binding sequence. The 3' UTR sequence was inserted by gene cloning into the 3' UTR of firefly luciferase as described in Example 2, and the vector produced in this manner was transfected into human embryonic kidney (HEK) cells simultaneously with the corresponding miRNA to measure the expression level of luciferase in the vector. At this time, renilla luciferase was also transfected simultaneously to calibrate the transfection efficiency. miRNA, firefly luciferase and Renilla luciferase were simultaneously injected and cultured for 48 hours and then measured with a luminometer (FIG. 8). Results showed that each target mRNA is directly controlled by the corresponding miRNA.

EXAMPLE 10 SYNTHESIS OF RNA OLIGO STRUCTURE

The double-stranded oligo RNA structure produced according to the present invention has a structure represented by the following Formula (5):

$$3'AS5'\text{-}PO_4 \qquad \text{[Formula (5)]}$$

wherein S represents a sense strand of miRNA, AS represents an anti-sense strand of miRNA, $PO_4$ represents a phosphate group, ethylene glycol is a hydrophilic material monomer, and hexaethylene glycols are bonded to through a phosphate group ($PO_3$-) as a linker (J), $C_{24}$ represents a tetradocosane containing a disulfide bond as a hydrophobic material, and 5' and 3' represent the end directions of double-stranded oligo RNA.

Regarding the sense strand of miRNA in Formula (5), a phosphodiester bond constituting an RNA backbone structure using β-cyanoethyl phosphoamidite and DMT-hexaethyl glycol-CPG as a support is linked, so an oligo RNA-hydrophilic material structure containing the sense strand wherein hexaethylene glycol is bonded to the 3' end is synthesized, and then tetradodecanoic acid containing a disulfide bond is bonded at the 5' end, to form a desired RNA-polymer structure of the sense strand. In the case of the antisense strand to be annealed with the strand, an antisense strand of the sequence complementary to the sense strand was prepared through the aforementioned reaction.

EXAMPLE 11 INDUCTION OF CELL APOPTOSIS MECHANISMS BY RNA STRUCTURE CONTAINING miRNA SEQUENCE

The RNA oligo structure was prepared by the method in accordance with Example 10 in order to ensure in vivo stability of the miRNA selected through Examples described above. In order to evaluate whether or not nanoparticles produced in this manner induced apoptosis in lung cancer cell lines, the lung cancer cell lines were seeded and cultured on a 6-well plate. The nanoparticles with different concentrations for respective wells were added to a culture medium. 48 hours after addition of the nanoparticles, the cells were stained with Annexin V labeled with an FIT-C fluorescent dye, and the degree of apoptosis was analyzed by flow cytometry. As can be seen from FIGS. 9A and 9B, miRNAs as the RNA structure kill cells dependent upon the concentration of treated miRNAs.

INDUSTRIAL APPLICABILITY

The double-stranded oligo RNA structure and the composition for treating cancer containing the same according to the present invention include at least one miRNA selected from the group consisting of miR-3670, miR-4477a and miR-8078, thereby being widely used as an anti-cancer therapeutic agent because of improved anti-cancer effects, as compared to the pharmaceutical composition for treating cancer containing miR-34a and other miRNAs as an active ingredient.

Although specific configurations of the present invention has been described in detail, those skilled in the art will appreciate that this description is provided as preferred embodiments for illustrative purposes and should not be construed as limiting the scope of the present invention. Therefore, the substantial scope of the present invention is defined by the accompanying claims and equivalents thereto.

SEQUENCE LISTING (3525 sequences)

SEQ ID NO: 1 - RNA, 22 nt, Artificial Sequence
  Synthetic Construct
aucacauugccagugauuaccc

SEQ ID NO: 2 - RNA, 22 nt, Artificial Sequence
  Synthetic Construct
guaaucacuggcaaugugauuu

SEQ ID NO: 3 - RNA, 22 nt, Artificial Sequence
  Synthetic Construct
agauguccagccacaauucucg

SEQ ID NO: 4 - RNA, 23 nt, Artificial Sequence
  Synthetic Construct
agaauugcguuuggacaaucagu

SEQ ID NO: 5 - RNA, 25 nt, Artificial Sequence
  Synthetic Construct
acuggacuuggagucagaagagugg

SEQ ID NO: 6 - RNA, 25 nt, Artificial Sequence
  Synthetic Construct
acucuucugacuccaaguccaguuu

SEQ ID NO: 7 - RNA, 25 nt, Artificial Sequence
  Synthetic Construct
aaaaaccacaauuacuuuugcacca

SEQ ID NO: 8 - RNA, 25 nt, Artificial Sequence
  Synthetic Construct
gugcaaaaguaauugugguuuuuuu

SEQ ID NO: 9 - RNA, 23 nt, Artificial Sequence
  Synthetic Construct
caaagacugcaauuacuuuugcg

SEQ ID NO: 10 - RNA, 23 nt, Artificial Sequence
  Synthetic Construct
caaaaguaauugcagucuuuguu

SEQ ID NO: 11 - RNA, 21 nt, Artificial Sequence
  Synthetic Construct
ugaguuggccaucugagugag

SEQ ID NO: 12 - RNA, 21 nt, Artificial Sequence
  Synthetic Construct
cacucagauggccaacucauu

SEQ ID NO: 13 - RNA, 24 nt, Artificial Sequence
  Synthetic Construct
aaagacauaggauagagucaccuc

SEQ ID NO: 14 - RNA, 24 nt, Artificial Sequence
  Synthetic Construct
ggugacucuauccuaugucuuuuu

SEQ ID NO: 15 - RNA, 26 nt, Artificial Sequence
  Synthetic Construct
aaguaguugguuuguaugagaugguu

SEQ ID NO: 16 - RNA, 26 nt, Artificial Sequence
  Synthetic Construct
ccaucucauacaaaccaacuacuuuu

SEQ ID NO: 17 - RNA, 27 nt, Artificial Sequence
  Synthetic Construct
accuucuuguauaagcacugugcuaaa

SEQ ID NO: 18 - RNA, 27 nt, Artificial Sequence
  Synthetic Construct
uagcacagugcuuauacaagaagguuu

SEQ ID NO: 19 - RNA, 21 nt, Artificial Sequence
  Synthetic Construct
caucugggcaacugacugaac

SEQ ID NO: 20 - RNA, 22 nt, Artificial Sequence
  Synthetic Construct
uucauucggcuguccagaugua

SEQ ID NO: 21 - RNA, 20 nt, Artificial Sequence
  Synthetic Construct
uaggaugggggugagaggug

SEQ ID NO: 22 - RNA, 20 nt, Artificial Sequence
  Synthetic Construct
ccucucacccccauccuauu

SEQ ID NO: 23 - RNA, 20 nt, Artificial Sequence
  Synthetic Construct
uggcuuuuaacuuugauggc

SEQ ID NO: 24 - RNA, 20 nt, Artificial Sequence
  Synthetic Construct
caucaaaguuaaaagccauu

SEQ ID NO: 25 - RNA, 22 nt, Artificial Sequence
  Synthetic Construct
ugugacuuuaagggaaauggcg

SEQ ID NO: 26 - RNA, 22 nt, Artificial Sequence
  Synthetic Construct
ccauuucccuuaaagucacauu

SEQ ID NO: 27 - RNA, 23 nt, Artificial Sequence
  Synthetic Construct
agaggcuuugugcggauacgggg

SEQ ID NO: 28 - RNA, 23 nt, Artificial Sequence
  Synthetic Construct
ccguauccgcacaaagccucuuu

SEQ ID NO: 29 - RNA, 24 nt, Artificial Sequence
  Synthetic Construct
caaagugaugaguaauacuggcug

SEQ ID NO: 30 - RNA, 24 nt, Artificial Sequence
  Synthetic Construct
gccaguauuacucaucacuuuguu

SEQ ID NO: 31 - RNA, 22 nt, Artificial Sequence
  Synthetic Construct
aggaggcaucuugagaaaugga

SEQ ID NO: 32 - RNA, 22 nt, Artificial Sequence
  Synthetic Construct
cauuucucaagaugccuccuuu

SEQ ID NO: 33 - RNA, 24 nt, Artificial Sequence
  Synthetic Construct
gaaaaugaugaguagugacugaug

SEQ ID NO: 34 - RNA, 24 nt, Artificial Sequence
  Synthetic Construct
ucagucacuacucaucauuuucuu

SEQ ID NO: 35 - RNA, 24 nt, Artificial Sequence
  Synthetic Construct
agagcucacagcuguccuucucua

SEQ ID NO: 36 - RNA, 24 nt, Artificial Sequence
  Synthetic Construct
gagaaggacagcugugagcucuuu

SEQ ID NO: 37 - RNA, 23 nt, Artificial Sequence
  Synthetic Construct
uagcccccaggcuucacuuggcg

SEQ ID NO: 38 - RNA, 23 nt, Artificial Sequence
  Synthetic Construct
ccaagugaagccugggggcuauu

SEQ ID NO: 39 - RNA, 22 nt, Artificial Sequence
  Synthetic Construct
agaguuaacucaaaauggacua

SEQ ID NO: 40 - RNA, 22 nt, Artificial Sequence
  Synthetic Construct
guccauuuugaguuaacucuuu

SEQ ID NO: 41 - RNA, 23 nt, Artificial Sequence
  Synthetic Construct
gauugagacuaguagggcuaggc

SEQ ID NO: 42 - RNA, 23 nt, Artificial Sequence
  Synthetic Construct
cuagcccuacuagucucaaucuu

SEQ ID NO: 43 - RNA, 22 nt, Artificial Sequence
  Synthetic Construct
cuauuaaggacauuugugauuc

SEQ ID NO: 44 - RNA, 22 nt, Artificial Sequence
  Synthetic Construct
aucacaaauguccuuaauaguu

SEQ ID NO: 45 - RNA, 22 nt, Artificial Sequence
  Synthetic Construct
auuaaggacauuugugauugau

SEQ ID NO: 46 - RNA, 22 nt, Artificial Sequence
  Synthetic Construct
caaucacaaauguccuuaauuu

SEQ ID NO: 47 - RNA, 22 nt, Artificial Sequence
  Synthetic Construct
ugagugauugauagcuauguuc

SEQ ID NO: 48 - RNA, 22 nt, Artificial Sequence
  Synthetic Construct
acauagcuaucaaucacucauu

SEQ ID NO: 49 - RNA, 22 nt, Artificial Sequence
  Synthetic Construct
cagaacaggagcauagaaaggc

SEQ ID NO: 50 - RNA, 22 nt, Artificial Sequence
  Synthetic Construct
cuuucuaugcuccuguucuguu

SEQ ID NO: 51 - RNA, 22 nt, Artificial Sequence
  Synthetic Construct
guggaccaggauggcaagggcu

SEQ ID NO: 52 - RNA, 23 nt, Artificial Sequence
  Synthetic Construct
cuugccauccugguccacugcau

SEQ ID NO: 53 - RNA, 21 nt, Artificial Sequence
  Synthetic Construct
ugcuguauugucagguaguga

SEQ ID NO: 54 - RNA, 20 nt, Artificial Sequence
  Synthetic Construct
ucacuaccugacaauacagu

SEQ ID NO: 55 - RNA, 21 nt, Artificial Sequence
  Synthetic Construct
guuucaccauguuggucaggc

SEQ ID NO: 56 - RNA, 21 nt, Artificial Sequence
  Synthetic Construct
cugaccaacauggugaaacuu

SEQ ID NO: 57 - RNA, 22 nt, Artificial Sequence
  Synthetic Construct
ucaaguaguuucaugauaaagg

SEQ ID NO: 58 - RNA, 22 nt, Artificial Sequence
  Synthetic Construct
uuuaucaugaaacuacuugauu

SEQ ID NO: 59 - RNA, 23 nt, Artificial Sequence
  Synthetic Construct
uguuucggggcucauggccugug

SEQ ID NO: 60 - RNA, 23 nt, Artificial Sequence
  Synthetic Construct
caggccaugagccccgaaacauu

SEQ ID NO: 61 - RNA, 22 nt, Artificial Sequence
  Synthetic Construct
acguuugaaugcuguacaaggc

SEQ ID NO: 62 - RNA, 22 nt, Artificial Sequence
  Synthetic Construct
cuuguacagcauucaaacguuu

SEQ ID NO: 63 - RNA, 24 nt, Artificial Sequence
  Synthetic Construct
uggcgauuuuggaacucaauggca

SEQ ID NO: 64 - RNA, 24 nt, Artificial Sequence
  Synthetic Construct
ccauugaguuccaaaaucgccauu

SEQ ID NO: 65 - RNA, 23 nt, Artificial Sequence
  Synthetic Construct
ggucuaggcccggugagagacuc

SEQ ID NO: 66 - RNA, 23 nt, Artificial Sequence
  Synthetic Construct
gucucucaccgggccuagaccuu

SEQ ID NO: 67 - RNA, 28 nt, Artificial Sequence
  Synthetic Construct
gacugguauagcugcuuuuggagccuca

SEQ ID NO: 68 - RNA, 22 nt, Artificial Sequence
  Synthetic Construct
aucacaaauguccuuaauggca

SEQ ID NO: 69 - RNA, 22 nt, Artificial Sequence
  Synthetic Construct
cuccaccgggcugaccggccug

SEQ ID NO: 70 - RNA, 22 nt, Artificial Sequence
  Synthetic Construct
ugagguaguagguuguauaguu

SEQ ID NO: 71 - RNA, 22 nt, Artificial Sequence
  Synthetic Construct
ugagguaguagguuguauaguu

SEQ ID NO: 72 - RNA, 22 nt, Artificial Sequence
  Synthetic Construct
cuauacaaccuacugccuuccc

SEQ ID NO: 73 - RNA, 22 nt, Artificial Sequence
  Synthetic Construct
ugagguaguagguuguaugguu

SEQ ID NO: 74 - RNA, 22 nt, Artificial Sequence
  Synthetic Construct
cuauacgaccugcugccuuucu

SEQ ID NO: 75 - RNA, 22 nt, Artificial Sequence
  Synthetic Construct
cuauacggccuccuagcuuucc

SEQ ID NO: 76 - RNA, 22 nt, Artificial Sequence
  Synthetic Construct
ugagguaguagauuguauaguu

SEQ ID NO: 77 - RNA, 22 nt, Artificial Sequence
  Synthetic Construct
ugagguaguagauuguauaguu

SEQ ID NO: 78 - RNA, 21 nt, Artificial Sequence
  Synthetic Construct
cuguacaggccacugccuugc

SEQ ID NO: 79 - RNA, 22 nt, Artificial Sequence
  Synthetic Construct
ugagguaguaguuugugcuguu

SEQ ID NO: 80 - RNA, 22 nt, Artificial Sequence
  Synthetic Construct
uggaauguaaagaaguauguau

SEQ ID NO: 81 - RNA, 22 nt, Artificial Sequence
  Synthetic Construct
caagcuuguaucuauagguaug

SEQ ID NO: 82 - RNA, 21 nt, Artificial Sequence
  Synthetic Construct
uacaguacugugauaacugaa

SEQ ID NO: 83 - RNA, 23 nt, Artificial Sequence
  Synthetic Construct
agcagcauuguacagggcuauga

SEQ ID NO: 84 - RNA, 23 nt, Artificial Sequence
  Synthetic Construct
ucauagcccuguacaaugcugcu

SEQ ID NO: 85 - RNA, 23 nt, Artificial Sequence
  Synthetic Construct
ucaaaugcucagacuccuguggu

SEQ ID NO: 86 - RNA, 22 nt, Artificial Sequence
  Synthetic Construct
cugcaauguaagcacuucuuac

SEQ ID NO: 87 - RNA, 21 nt, Artificial Sequence
  Synthetic Construct
uaaagugcugacagugcagau

SEQ ID NO: 88 - RNA, 23 nt, Artificial Sequence
  Synthetic Construct
agcagcauuguacagggcuauca

SEQ ID NO: 89 - RNA, 22 nt, Artificial Sequence
  Synthetic Construct
caaauucguaucuaggggaaua

SEQ ID NO: 90 - RNA, 22 nt, Artificial Sequence
  Synthetic Construct
acagauucgauucuaggggaau

SEQ ID NO: 91 - RNA, 21 nt, Artificial Sequence
  Synthetic Construct
uugcucacuguucuucccuag

SEQ ID NO: 92 - RNA, 21 nt, Artificial Sequence
  Synthetic Construct
aagcauucuuucauugguugg

SEQ ID NO: 93 - RNA, 22 nt, Artificial Sequence
  Synthetic Construct
uuuccggcucgcgugggugugu

SEQ ID NO: 94 - RNA, 21 nt, Artificial Sequence
  Synthetic Construct
ccgucgccgccacccgagccg

SEQ ID NO: 95 - RNA, 23 nt, Artificial Sequence
  Synthetic Construct
gagggucuugggagggaugugac

SEQ ID NO: 96 - RNA, 27 nt, Artificial Sequence
  Synthetic Construct
cacuguaggugauggugagagugggca

SEQ ID NO: 97 - RNA, 23 nt, Artificial Sequence
  Synthetic Construct
ccugcagcgacuugauggcuucc

SEQ ID NO: 98 - RNA, 21 nt, Artificial Sequence
  Synthetic Construct
agaggauacccuuuguauguu

SEQ ID NO: 99 - RNA, 21 nt, Artificial Sequence
  Synthetic Construct
agaggauacccuuuguauguu

SEQ ID NO: 100 - RNA, 23 nt, Artificial Sequence
  Synthetic Construct
gggaugguagaccggugacgugc

SEQ ID NO: 101 - RNA, 21 nt, Artificial Sequence
  Synthetic Construct
uaggacacauggucuacuucu

SEQ ID NO: 102 - RNA, 20 nt, Artificial Sequence
  Synthetic Construct
ccugagcccgggccgcgcag

SEQ ID NO: 103 - RNA, 22 nt, Artificial Sequence
  Synthetic Construct
cuccugagccauucugagccuc

SEQ ID NO: 104 - RNA, 21 nt, Artificial Sequence
  Synthetic Construct
gugccagcugcagugggggag

SEQ ID NO: 105 - RNA, 21 nt, Artificial Sequence
  Synthetic Construct
cccggagccaggaugcagcuc

SEQ ID NO: 106 - RNA, 21 nt, Artificial Sequence
  Synthetic Construct
ucguggccuggucuccauuau

SEQ ID NO: 107 - RNA, 20 nt, Artificial Sequence
  Synthetic Construct
ucugcaggguuugcuuugag

SEQ ID NO: 108 - RNA, 21 nt, Artificial Sequence
  Synthetic Construct
uguucauguagauguuuaagc

SEQ ID NO: 109 - RNA, 21 nt, Artificial Sequence
  Synthetic Construct
uggcagggaggcugggagggg

SEQ ID NO: 110 - RNA, 20 nt, Artificial Sequence
  Synthetic Construct
ucacuguucagacaggcgga

SEQ ID NO: 111 - RNA, 22 nt, Artificial Sequence
  Synthetic Construct
uggagugugacaaugguguuug

SEQ ID NO: 112 - RNA, 21 nt, Artificial Sequence
  Synthetic Construct
ccccaccuccucucuccucag

SEQ ID NO: 113 - RNA, 22 nt, Artificial Sequence
  Synthetic Construct
guggguacggcccagugggggg

SEQ ID NO: 114 - RNA, 26 nt, Artificial Sequence
  Synthetic Construct
gugagggcaugcaggccuggaugggg

SEQ ID NO: 115 - RNA, 17 nt, Artificial Sequence
  Synthetic Construct
guggggccaggcggugg

SEQ ID NO: 116 - RNA, 21 nt, Artificial Sequence
  Synthetic Construct
gugggcgggggcaggugugug

SEQ ID NO: 117 - RNA, 24 nt, Artificial Sequence
  Synthetic Construct
guggguaggguuugggggagagcg

SEQ ID NO: 118 - RNA, 20 nt, Artificial Sequence
  Synthetic Construct
gugucugggcggacagcugc

SEQ ID NO: 119 - RNA, 22 nt, Artificial Sequence
  Synthetic Construct
agugggaggccagggcacggca

SEQ ID NO: 120 - RNA, 22 nt, Artificial Sequence
  Synthetic Construct
ucggccugaccacccaccccac

SEQ ID NO: 121 - RNA, 22 nt, Artificial Sequence
  Synthetic Construct
ugagugacaggggaaaugggga

SEQ ID NO: 122 - RNA, 21 nt, Artificial Sequence
  Synthetic Construct
cgggggcggggccgaagcgcg

SEQ ID NO: 123 - RNA, 20 nt, Artificial Sequence
  Synthetic Construct
cuuccucgucugucugcccc

SEQ ID NO: 124 - RNA, 20 nt, Artificial Sequence
  Synthetic Construct
uaaggcacgcggugaaugcc

SEQ ID NO: 125 - RNA, 22 nt, Artificial Sequence
  Synthetic Construct
aacuggaucaauuauaggagug

SEQ ID NO: 126 - RNA, 26 nt, Artificial Sequence
  Synthetic Construct
aaguaguugguuuguaugagaugguu

SEQ ID NO: 127 - RNA, 21 nt, Artificial Sequence
  Synthetic Construct
aagugaucuaaaggccuacau

SEQ ID NO: 128 - RNA, 22 nt, Artificial Sequence
  Synthetic Construct
ucagaugaucuaaaggccuaua

SEQ ID NO: 129 - RNA, 19 nt, Artificial Sequence
  Synthetic Construct
aauggauuuuuggagcagg

SEQ ID NO: 130 - RNA, 24 nt, Artificial Sequence
  Synthetic Construct
ccccgggaacgucgagacuggagc

SEQ ID NO: 131 - RNA, 27 nt, Artificial Sequence
  Synthetic Construct
accuucuuguauaagcacugugcuaaa

SEQ ID NO: 132 - RNA, 22 nt, Artificial Sequence
  Synthetic Construct
acgcccuucccccccuucuuca

SEQ ID NO: 133 - RNA, 19 nt, Artificial Sequence
  Synthetic Construct
acauuuuccagcccauuca

SEQ ID NO: 134 - RNA, 21 nt, Artificial Sequence
  Synthetic Construct
cgcuuugcucagccaguguag

SEQ ID NO: 135 - RNA, 22 nt, Artificial Sequence
  Synthetic Construct
agaaggaaauugaauucauuua

SEQ ID NO: 136 - RNA, 21 nt, Artificial Sequence
  Synthetic Construct
agagaagaagaucagccugca

SEQ ID NO: 137 - RNA, 24 nt, Artificial Sequence
  Synthetic Construct
agccuggaagcuggagccugcagu

SEQ ID NO: 138 - RNA, 23 nt, Artificial Sequence
  Synthetic Construct
aggaugagcaaagaaaguagauu

SEQ ID NO: 139 - RNA, 22 nt, Artificial Sequence
  Synthetic Construct
aaccacuuucuuugcucaucca

SEQ ID NO: 140 - RNA, 22 nt, Artificial Sequence
  Synthetic Construct
aggcauugacuucucacuagcu

SEQ ID NO: 141 - RNA, 21 nt, Artificial Sequence
  Synthetic Construct
agugaaugauggguucugacc

SEQ ID NO: 142 - RNA, 21 nt, Artificial Sequence
  Synthetic Construct
aguuaggauuaggucguggaa

SEQ ID NO: 143 - RNA, 22 nt, Artificial Sequence
  Synthetic Construct
acaggugagguucuugggagcc

SEQ ID NO: 144 - RNA, 22 nt, Artificial Sequence
  Synthetic Construct
ucccugagacccuaacuuguga

SEQ ID NO: 145 - RNA, 22 nt, Artificial Sequence
  Synthetic Construct
ucccugagacccuaacuuguga

SEQ ID NO: 146 - RNA, 22 nt, Artificial Sequence
  Synthetic Construct
ucguaccgugaguaauaaugcg

SEQ ID NO: 147 - RNA, 18 nt, Artificial Sequence
  Synthetic Construct
aucccaccucugccacca

SEQ ID NO: 148 - RNA, 19 nt, Artificial Sequence
  Synthetic Construct
aucccaccacugccaccau

SEQ ID NO: 149 - RNA, 19 nt, Artificial Sequence
  Synthetic Construct
auggauaaggcuuuggcuu

SEQ ID NO: 150 - RNA, 22 nt, Artificial Sequence
  Synthetic Construct
augggugaauuuguagaaggau

SEQ ID NO: 151 - RNA, 22 nt, Artificial Sequence
  Synthetic Construct
augguacccuggcauacugagu

SEQ ID NO: 152 - RNA, 23 nt, Artificial Sequence
  Synthetic Construct
caagucuuauuugagcaccuguu

SEQ ID NO: 153 - RNA, 22 nt, Artificial Sequence
  Synthetic Construct
caggauguggucaaguguuguu

SEQ ID NO: 154 - RNA, 23 nt, Artificial Sequence
  Synthetic Construct
ccucagggcuguagaacagggcu

SEQ ID NO: 155 - RNA, 21 nt, Artificial Sequence
  Synthetic Construct
ccuguugaaguguaaucccca

SEQ ID NO: 156 - RNA, 18 nt, Artificial Sequence
  Synthetic Construct
cgggcguggugguggggg

SEQ ID NO: 157 - RNA, 20 nt, Artificial Sequence
  Synthetic Construct
cgggcgugguggugggggug

SEQ ID NO: 158 - RNA, 22 nt, Artificial Sequence
  Synthetic Construct
cuggacugagccgugcuacugg

SEQ ID NO: 159 - RNA, 22 nt, Artificial Sequence
  Synthetic Construct
cuggacugagccaugcuacugg

SEQ ID NO: 160 - RNA, 22 nt, Artificial Sequence
  Synthetic Construct
ucggauccgucugagcuuggcu

SEQ ID NO: 161 - RNA, 23 nt, Artificial Sequence
  Synthetic Construct
cuggagauauggaagagcugugu

SEQ ID NO: 162 - RNA, 22 nt, Artificial Sequence
  Synthetic Construct
agugccugcuaugugccaggca

SEQ ID NO: 163 - RNA, 26 nt, Artificial Sequence
  Synthetic Construct
gaugaugauggcagcaaauucugaaa

SEQ ID NO: 164 - RNA, 25 nt, Artificial Sequence
  Synthetic Construct
gggcgacaaagcaagacucuuucuu

SEQ ID NO: 165 - RNA, 22 nt, Artificial Sequence
  Synthetic Construct
ggcgacaaaacgagacccuguc

SEQ ID NO: 166 - RNA, 25 nt, Artificial Sequence
  Synthetic Construct
gaacccaugagguugaggcugcagu

SEQ ID NO: 167 - RNA, 22 nt, Artificial Sequence
  Synthetic Construct
uugcuugaacccaggaagugga

SEQ ID NO: 168 - RNA, 19 nt, Artificial Sequence
  Synthetic Construct
ggagauggagguugcagug

SEQ ID NO: 169 - RNA, 22 nt, Artificial Sequence
  Synthetic Construct
ggugguugaggcugcaguaagu

SEQ ID NO: 170 - RNA, 21 nt, Artificial Sequence
  Synthetic Construct
cugggaggucaaggcugcagu

SEQ ID NO: 171 - RNA, 17 nt, Artificial Sequence
  Synthetic Construct
gugggggagaggcuguc

SEQ ID NO: 172 - RNA, 20 nt, Artificial Sequence
  Synthetic Construct
uaaagagcccuguggagaca

SEQ ID NO: 173 - RNA, 22 nt, Artificial Sequence
  Synthetic Construct
uacguagauauauauguauuuu

SEQ ID NO: 174 - RNA, 22 nt, Artificial Sequence
  Synthetic Construct
uaguacugugcauaucaucuau

SEQ ID NO: 175 - RNA, 17 nt, Artificial Sequence
  Synthetic Construct
ucauauugcuucuuucu

SEQ ID NO: 176 - RNA, 21 nt, Artificial Sequence
  Synthetic Construct
ucacagugaaccggucucuuu

SEQ ID NO: 177 - RNA, 21 nt, Artificial Sequence
  Synthetic Construct
ucacagugaaccggucucuuu

SEQ ID NO: 178 - RNA, 17 nt, Artificial Sequence
  Synthetic Construct
ucgccuccuccucuccc

SEQ ID NO: 179 - RNA, 20 nt, Artificial Sequence
  Synthetic Construct
ucguuugccuuuuucugcuu

SEQ ID NO: 180 - RNA, 22 nt, Artificial Sequence
  Synthetic Construct
ucuacaaaggaaagcgcuuucu

SEQ ID NO: 181 - RNA, 22 nt, Artificial Sequence
  Synthetic Construct
ucuauacagacccuggcuuuuc

SEQ ID NO: 182 - RNA, 22 nt, Artificial Sequence
  Synthetic Construct
ucugggcaacaaagugagaccu

SEQ ID NO: 183 - RNA, 21 nt, Artificial Sequence
  Synthetic Construct
ugcaggaccaagaugagcccu

SEQ ID NO: 184 - RNA, 22 nt, Artificial Sequence
  Synthetic Construct
cucuagccacagaugcagugau

SEQ ID NO: 185 - RNA, 21 nt, Artificial Sequence
  Synthetic Construct
uggacugcccugaucuggaga

SEQ ID NO: 186 - RNA, 23 nt, Artificial Sequence
  Synthetic Construct
uggaguccaggaaucugcauuuu

SEQ ID NO: 187 - RNA, 21 nt, Artificial Sequence
  Synthetic Construct
cuuuuugcggucugggcuugc

SEQ ID NO: 188 - RNA, 21 nt, Artificial Sequence
  Synthetic Construct
cuuuuugcggucugggcuugc

SEQ ID NO: 189 - RNA, 19 nt, Artificial Sequence
  Synthetic Construct
uggauuuuuggaucaggga

SEQ ID NO: 190 - RNA, 24 nt, Artificial Sequence
  Synthetic Construct
uggcccugacugaagaccagcagu

SEQ ID NO: 191 - RNA, 25 nt, Artificial Sequence
  Synthetic Construct
ugggaacggguuccggcagacgcug

SEQ ID NO: 192 - RNA, 22 nt, Artificial Sequence
  Synthetic Construct
uggguggucuggagauuugugc

SEQ ID NO: 193 - RNA, 22 nt, Artificial Sequence
  Synthetic Construct
ugugagguuggcauuguugucu

SEQ ID NO: 194 - RNA, 21 nt, Artificial Sequence
  Synthetic Construct
uuaggccgcagaucuggguga

SEQ ID NO: 195 - RNA, 22 nt, Artificial Sequence
  Synthetic Construct
aauaggccacggaucugggcaa

SEQ ID NO: 196 - RNA, 22 nt, Artificial Sequence
  Synthetic Construct
uuagggcccuggcuccaucucc

SEQ ID NO: 197 - RNA, 17 nt, Artificial Sequence
  Synthetic Construct
uucaaguaauucaggug

SEQ ID NO: 198 - RNA, 21 nt, Artificial Sequence
  Synthetic Construct
caucugggcaacugacugaac

SEQ ID NO: 199 - RNA, 22 nt, Artificial Sequence
  Synthetic Construct
uucuggaauucugugugaggga

SEQ ID NO: 200 - RNA, 19 nt, Artificial Sequence
  Synthetic Construct
cgcucuaggcaccgcagca

SEQ ID NO: 201 - RNA, 21 nt, Artificial Sequence
  Synthetic Construct
uugggacauacuuaugcuaaa

SEQ ID NO: 202 - RNA, 22 nt, Artificial Sequence
  Synthetic Construct
uuuagagacggggucuugcucu

SEQ ID NO: 203 - RNA, 22 nt, Artificial Sequence
  Synthetic Construct
uuugaggcuacagugagaugug

SEQ ID NO: 204 - RNA, 22 nt, Artificial Sequence
  Synthetic Construct
uuuucaacucuaaugggagaga

SEQ ID NO: 205 - RNA, 22 nt, Artificial Sequence
  Synthetic Construct
ccaccuccccugcaaacgucca

SEQ ID NO: 206 - RNA, 22 nt, Artificial Sequence
  Synthetic Construct
acucggcguggcgucggucgug

SEQ ID NO: 207 - RNA, 22 nt, Artificial Sequence
  Synthetic Construct
uucacauugugcuacugucugc

SEQ ID NO: 208 - RNA, 22 nt, Artificial Sequence
  Synthetic Construct
cagugcaaugaugaaagggcau

SEQ ID NO: 209 - RNA, 22 nt, Artificial Sequence
  Synthetic Construct
uaacagucuacagccauggucg

SEQ ID NO: 210 - RNA, 18 nt, Artificial Sequence
  Synthetic Construct
cagggaggugaaugugau

SEQ ID NO: 211 - RNA, 19 nt, Artificial Sequence
  Synthetic Construct
gaugaugcugcugaugcug

SEQ ID NO: 212 - RNA, 22 nt, Artificial Sequence
  Synthetic Construct
ucaaaacugaggggcauuuucu

SEQ ID NO: 213 - RNA, 24 nt, Artificial Sequence
  Synthetic Construct
ccagacagaauucuaugcacuuuc

SEQ ID NO: 214 - RNA, 22 nt, Artificial Sequence
  Synthetic Construct
agcugguaaaauggaaccaaau

SEQ ID NO: 215 - RNA, 22 nt, Artificial Sequence
  Synthetic Construct
uuugguccccuucaaccagcua

SEQ ID NO: 216 - RNA, 22 nt, Artificial Sequence
  Synthetic Construct
ugugacugguugaccagagggg

SEQ ID NO: 217 - RNA, 22 nt, Artificial Sequence
  Synthetic Construct
cuccuggggcccgcacucucgc

SEQ ID NO: 218 - RNA, 22 nt, Artificial Sequence
  Synthetic Construct
uauagggauuggagccguggcg

SEQ ID NO: 219 - RNA, 22 nt, Artificial Sequence
  Synthetic Construct
auguagggcuaaaagccauggg

SEQ ID NO: 220 - RNA, 22 nt, Artificial Sequence
  Synthetic Construct
caucaucgucucaaaugagucu

SEQ ID NO: 221 - RNA, 23 nt, Artificial Sequence
  Synthetic Construct
uuauugcuuaagaauacgcguag

SEQ ID NO: 222 - RNA, 23 nt, Artificial Sequence
  Synthetic Construct
agcugguguugugaaucaggccg

SEQ ID NO: 223 - RNA, 23 nt, Artificial Sequence
  Synthetic Construct
agcugguguugugaaucaggccg

SEQ ID NO: 224 - RNA, 23 nt, Artificial Sequence
  Synthetic Construct
ucuacagugcacgugucuccagu

SEQ ID NO: 225 - RNA, 22 nt, Artificial Sequence
  Synthetic Construct
cagugguuuuacccuaugguag

SEQ ID NO: 226 - RNA, 22 nt, Artificial Sequence
  Synthetic Construct
uaacacugucugguaaagaugg

SEQ ID NO: 227 - RNA, 21 nt, Artificial Sequence
  Synthetic Construct
cauaaaguagaaagcacuacu

SEQ ID NO: 228 - RNA, 22 nt, Artificial Sequence
  Synthetic Construct
ggugcagugcugcaucucuggu

SEQ ID NO: 229 - RNA, 20 nt, Artificial Sequence
  Synthetic Construct
uacaguauagaugauguacu

SEQ ID NO: 230 - RNA, 23 nt, Artificial Sequence
  Synthetic Construct
guccaguuuucccaggaaucccu

SEQ ID NO: 231 - RNA, 21 nt, Artificial Sequence
  Synthetic Construct
cuccguuugccuguuucgcug

SEQ ID NO: 232 - RNA, 22 nt, Artificial Sequence
  Synthetic Construct
cucggcgcggggcgcgggcucc

SEQ ID NO: 233 - RNA, 22 nt, Artificial Sequence
  Synthetic Construct
ugagaacugaauuccauggguu

SEQ ID NO: 234 - RNA, 22 nt, Artificial Sequence
  Synthetic Construct
ugcccuguggacucaguucugg

SEQ ID NO: 235 - RNA, 21 nt, Artificial Sequence
  Synthetic Construct
gcccuccgcccgugcaccccg

SEQ ID NO: 236 - RNA, 22 nt, Artificial Sequence
  Synthetic Construct
gcccgcguguggagccaggugu

SEQ ID NO: 237 - RNA, 20 nt, Artificial Sequence
  Synthetic Construct
guguguggaaaugcuucugc

SEQ ID NO: 238 - RNA, 22 nt, Artificial Sequence
  Synthetic Construct
gugugcggaaaugcuucugcua

SEQ ID NO: 239 - RNA, 22 nt, Artificial Sequence
  Synthetic Construct
aaaguucugagacacuccgacu

SEQ ID NO: 240 - RNA, 22 nt, Artificial Sequence
  Synthetic Construct
aaguucuguuauacacucaggc

SEQ ID NO: 241 - RNA, 21 nt, Artificial Sequence
  Synthetic Construct
agggagggacgggggcugugc

SEQ ID NO: 242 - RNA, 22 nt, Artificial Sequence
  Synthetic Construct
cugguacaggccugggggacag

SEQ ID NO: 243 - RNA, 21 nt, Artificial Sequence
  Synthetic Construct
ucgaggagcucacagucuagu

SEQ ID NO: 244 - RNA, 18 nt, Artificial Sequence
  Synthetic Construct
ucgaggagcucacagucu

SEQ ID NO: 245 - RNA, 23 nt, Artificial Sequence
  Synthetic Construct
agguucugugauacacuccgacu

SEQ ID NO: 246 - RNA, 22 nt, Artificial Sequence
  Synthetic Construct
ucauuuuugugauguugcagcu

SEQ ID NO: 247 - RNA, 22 nt, Artificial Sequence
  Synthetic Construct
agcuguaauuagucaguuuucu

SEQ ID NO: 248 - RNA, 23 nt, Artificial Sequence
  Synthetic Construct
cggcccgggcugcugcuguuccu

SEQ ID NO: 249 - RNA, 21 nt, Artificial Sequence
  Synthetic Construct
uccugcgcgucccagaugccc

SEQ ID NO: 250 - RNA, 22 nt, Artificial Sequence
  Synthetic Construct
aaucauacacgguugaccuauu

SEQ ID NO: 251 - RNA, 22 nt, Artificial Sequence
  Synthetic Construct
cuccuacauauuagcauuaaca

SEQ ID NO: 252 - RNA, 20 nt, Artificial Sequence
  Synthetic Construct
uugggcugggcuggguuggg

SEQ ID NO: 253 - RNA, 22 nt, Artificial Sequence
  Synthetic Construct
caggccauauugugcugccuca

SEQ ID NO: 254 - RNA, 22 nt, Artificial Sequence
  Synthetic Construct
cgaaucauuauuugcugcucua

SEQ ID NO: 255 - RNA, 22 nt, Artificial Sequence
  Synthetic Construct
uagcagcacguaaauauuggcg

SEQ ID NO: 256 - RNA, 22 nt, Artificial Sequence
  Synthetic Construct
uagcagcacguaaauauuggcg

SEQ ID NO: 257 - RNA, 22 nt, Artificial Sequence
  Synthetic Construct
acugcagugaaggcacuuguag

SEQ ID NO: 258 - RNA, 23 nt, Artificial Sequence
  Synthetic Construct
aacauucaacgcugucggugagu

SEQ ID NO: 259 - RNA, 23 nt, Artificial Sequence
  Synthetic Construct
aacauucaacgcugucggugagu

SEQ ID NO: 260 - RNA, 23 nt, Artificial Sequence
  Synthetic Construct
aacauucauugcugucggugggu

SEQ ID NO: 261 - RNA, 23 nt, Artificial Sequence
  Synthetic Construct
aacauucauugcugucggugggu

SEQ ID NO: 262 - RNA, 22 nt, Artificial Sequence
  Synthetic Construct
aaccaucgaccguugaguggac

SEQ ID NO: 263 - RNA, 21 nt, Artificial Sequence
  Synthetic Construct
ccaccgggggaugaaugucac

SEQ ID NO: 264 - RNA, 24 nt, Artificial Sequence
  Synthetic Construct
uuuggcaaugguagaacucacacu

SEQ ID NO: 265 - RNA, 18 nt, Artificial Sequence
  Synthetic Construct
uccagugcccuccucucc

SEQ ID NO: 266 - RNA, 18 nt, Artificial Sequence
  Synthetic Construct
ugaggcaguagauugaau

SEQ ID NO: 267 - RNA, 22 nt, Artificial Sequence
  Synthetic Construct
uauggcacugguagaauucacu

SEQ ID NO: 268 - RNA, 22 nt, Artificial Sequence
  Synthetic Construct
uggacggagaacugauaagggu

SEQ ID NO: 269 - RNA, 22 nt, Artificial Sequence
  Synthetic Construct
aggggcuggcuuuccucugguc

SEQ ID NO: 270 - RNA, 22 nt, Artificial Sequence
  Synthetic Construct
caaagaauucuccuuuugggcu

SEQ ID NO: 271 - RNA, 22 nt, Artificial Sequence
  Synthetic Construct
ucgugucuuguguugcagccgg

SEQ ID NO: 272 - RNA, 21 nt, Artificial Sequence
  Synthetic Construct
caucccuugcaugguggaggg

SEQ ID NO: 273 - RNA, 23 nt, Artificial Sequence
  Synthetic Construct
uaaggugcaucuagugcagauag

SEQ ID NO: 274 - RNA, 23 nt, Artificial Sequence
  Synthetic Construct
uaaggugcaucuagugcaguuag

SEQ ID NO: 275 - RNA, 21 nt, Artificial Sequence
  Synthetic Construct
cggcggggacggcgauugguc

SEQ ID NO: 276 - RNA, 22 nt, Artificial Sequence
  Synthetic Construct
cgcaggggccgggugcucaccg

SEQ ID NO: 277 - RNA, 22 nt, Artificial Sequence
  Synthetic Construct
ugauauguuugauauauuaggu

SEQ ID NO: 278 - RNA, 21 nt, Artificial Sequence
  Synthetic Construct
ugauauguuugauauuggguu

SEQ ID NO: 279 - RNA, 22 nt, Artificial Sequence
  Synthetic Construct
gcugcgcuuggauuucgucccc

SEQ ID NO: 280 - RNA, 21 nt, Artificial Sequence
  Synthetic Construct
ccaguccugugccugccgccu

SEQ ID NO: 281 - RNA, 20 nt, Artificial Sequence
  Synthetic Construct
caccaggcauuguggucucc

SEQ ID NO: 282 - RNA, 22 nt, Artificial Sequence
  Synthetic Construct
uacccagagcaugcagugugaa

SEQ ID NO: 283 - RNA, 22 nt, Artificial Sequence
  Synthetic Construct
ucugcccccuccgcugcugcca

SEQ ID NO: 284 - RNA, 22 nt, Artificial Sequence
  Synthetic Construct
cccugugcccggcccacuucug

SEQ ID NO: 285 - RNA, 22 nt, Artificial Sequence
  Synthetic Construct
accuugccuugcugcccgggcc

SEQ ID NO: 286 - RNA, 22 nt, Artificial Sequence
  Synthetic Construct
cugccaauuccauaggucacag

SEQ ID NO: 287 - RNA, 22 nt, Artificial Sequence
  Synthetic Construct
ugggucuuugcgggcgagauga

SEQ ID NO: 288 - RNA, 22 nt, Artificial Sequence
  Synthetic Construct
cgggguuuugagggcgagauga

SEQ ID NO: 289 - RNA, 22 nt, Artificial Sequence
  Synthetic Construct
uguaacagcaacuccaugugga

SEQ ID NO: 290 - RNA, 21 nt, Artificial Sequence
  Synthetic Construct
uagcagcacagaaauauuggc

SEQ ID NO: 291 - RNA, 22 nt, Artificial Sequence
  Synthetic Construct
uagguaguuucauguuguuggg

SEQ ID NO: 292 - RNA, 22 nt, Artificial Sequence
  Synthetic Construct
ucgacagcacgacacugccuuc

SEQ ID NO: 293 - RNA, 23 nt, Artificial Sequence
  Synthetic Construct
cggguagagagggcagugggagg

SEQ ID NO: 294 - RNA, 22 nt, Artificial Sequence
  Synthetic Construct
ucaggccaggcacaguggcuca

SEQ ID NO: 295 - RNA, 19 nt, Artificial Sequence
  Synthetic Construct
accgugcaaagguagcaua

SEQ ID NO: 296 - RNA, 20 nt, Artificial Sequence
  Synthetic Construct
ccuccugcccuccuugcugu

SEQ ID NO: 297 - RNA, 22 nt, Artificial Sequence
  Synthetic Construct
gguccagaggggagauagguuc

SEQ ID NO: 298 - RNA, 22 nt, Artificial Sequence
  Synthetic Construct
acaguagucugcacauugguua

SEQ ID NO: 299 - RNA, 23 nt, Artificial Sequence
  Synthetic Construct
cccaguguuuagacuaucuguuc

SEQ ID NO: 300 - RNA, 23 nt, Artificial Sequence
  Synthetic Construct
ugugcaaaucuaugcaaaacuga

SEQ ID NO: 301 - RNA, 23 nt, Artificial Sequence
  Synthetic Construct
ugugcaaauccaugcaaaacuga

SEQ ID NO: 302 - RNA, 23 nt, Artificial Sequence
  Synthetic Construct
ugugcaaauccaugcaaaacuga

SEQ ID NO: 303 - RNA, 22 nt, Artificial Sequence
  Synthetic Construct
uaacacugucugguaacgaugu

SEQ ID NO: 304 - RNA, 22 nt, Artificial Sequence
  Synthetic Construct
caucuuacugggcagcauugga

SEQ ID NO: 305 - RNA, 23 nt, Artificial Sequence
  Synthetic Construct
uaauacugccggguaaugaugga

SEQ ID NO: 306 - RNA, 22 nt, Artificial Sequence
  Synthetic Construct
uuccuaugcauauacuucuuug

SEQ ID NO: 307 - RNA, 25 nt, Artificial Sequence
  Synthetic Construct
agugguucuuaacaguucaacaguu

SEQ ID NO: 308 - RNA, 22 nt, Artificial Sequence
  Synthetic Construct
uagugguccuaaacauuucaca

SEQ ID NO: 309 - RNA, 21 nt, Artificial Sequence
  Synthetic Construct
gcugggaaggcaaagggacgu

SEQ ID NO: 310 - RNA, 22 nt, Artificial Sequence
  Synthetic Construct
uccuucauuccaccggagucug

SEQ ID NO: 311 - RNA, 20 nt, Artificial Sequence
  Synthetic Construct
uguuuugauaacaguaaugu

SEQ ID NO: 312 - RNA, 23 nt, Artificial Sequence
  Synthetic Construct
guguuaauuaaaccucuauuuac

SEQ ID NO: 313 - RNA, 23 nt, Artificial Sequence
  Synthetic Construct
cuguaauauaaauuuaauuuauu

SEQ ID NO: 314 - RNA, 22 nt, Artificial Sequence
  Synthetic Construct
uggaauguaaggaagugugugg

SEQ ID NO: 315 - RNA, 22 nt, Artificial Sequence
  Synthetic Construct
auaagacgagcaaaaagcuugu

SEQ ID NO: 316 - RNA, 22 nt, Artificial Sequence
  Synthetic Construct
aagcuuuuugcucgaauuaugu

SEQ ID NO: 317 - RNA, 23 nt, Artificial Sequence
  Synthetic Construct
uaaagugcuuauagugcagguag

SEQ ID NO: 318 - RNA, 23 nt, Artificial Sequence
  Synthetic Construct
caaagugcucauagugcagguag

SEQ ID NO: 319 - RNA, 22 nt, Artificial Sequence
  Synthetic Construct
uagcuuaucagacugauguuga

SEQ ID NO: 320 - RNA, 22 nt, Artificial Sequence
  Synthetic Construct
agccccugcccaccgcacacug

SEQ ID NO: 321 - RNA, 21 nt, Artificial Sequence
  Synthetic Construct
gcagggacagcaaaggggugc

SEQ ID NO: 322 - RNA, 22 nt, Artificial Sequence
  Synthetic Construct
uuggggaaacggccgcugagug

SEQ ID NO: 323 - RNA, 21 nt, Artificial Sequence
  Synthetic Construct
auuugugcuuggcucugucac

SEQ ID NO: 324 - RNA, 22 nt, Artificial Sequence
  Synthetic Construct
uagucccuuccuugaagcgguc

SEQ ID NO: 325 - RNA, 22 nt, Artificial Sequence
  Synthetic Construct
caucagaauucauggaggcuag

SEQ ID NO: 326 - RNA, 21 nt, Artificial Sequence
  Synthetic Construct
gguucuuagcauaggaggucu

SEQ ID NO: 327 - RNA, 21 nt, Artificial Sequence
  Synthetic Construct
uguucucuuugccaaggacag

SEQ ID NO: 328 - RNA, 21 nt, Artificial Sequence
  Synthetic Construct
uaacagucuccagucacggcc

SEQ ID NO: 329 - RNA, 22 nt, Artificial Sequence
  Synthetic Construct
ugccugucuacacuugcugugc

SEQ ID NO: 330 - RNA, 23 nt, Artificial Sequence
  Synthetic Construct
ucugucauuucuuuaggccaaua

SEQ ID NO: 331 - RNA, 22 nt, Artificial Sequence
  Synthetic Construct
uaaucucagcuggcaacuguga

SEQ ID NO: 332 - RNA, 22 nt, Artificial Sequence
  Synthetic Construct
aaaucucugcaggcaaauguga

SEQ ID NO: 333 - RNA, 23 nt, Artificial Sequence
  Synthetic Construct
uacugcaucaggaacugauugga

SEQ ID NO: 334 - RNA, 21 nt, Artificial Sequence
  Synthetic Construct
uugugcuugaucuaaccaugu

SEQ ID NO: 335 - RNA, 21 nt, Artificial Sequence
  Synthetic Construct
uugugcuugaucuaaccaugu

SEQ ID NO: 336 - RNA, 21 nt, Artificial Sequence
  Synthetic Construct
ugauuguccaaacgcaauucu

SEQ ID NO: 337 - RNA, 21 nt, Artificial Sequence
  Synthetic Construct
ugauuguccaaacgcaauucu

SEQ ID NO: 338 - RNA, 22 nt, Artificial Sequence
  Synthetic Construct
agauguccagccacaauucucg

SEQ ID NO: 339 - RNA, 22 nt, Artificial Sequence
  Synthetic Construct
aguucuucaguggcaagcuuua

SEQ ID NO: 340 - RNA, 23 nt, Artificial Sequence
  Synthetic Construct
agcuacauugucugcuggguuuc

SEQ ID NO: 341 - RNA, 21 nt, Artificial Sequence
  Synthetic Construct
agcuacaucuggcuacugggu

SEQ ID NO: 342 - RNA, 22 nt, Artificial Sequence
  Synthetic Construct
cguguauuugacaagcugaguu

SEQ ID NO: 343 - RNA, 23 nt, Artificial Sequence
  Synthetic Construct
aaaauggugcccuagugacuaca

SEQ ID NO: 344 - RNA, 22 nt, Artificial Sequence
  Synthetic Construct
gcccucugucaccuugcagacg

SEQ ID NO: 345 - RNA, 24 nt, Artificial Sequence
  Synthetic Construct
agcgcgggcugagcgcugccaguc

SEQ ID NO: 346 - RNA, 22 nt, Artificial Sequence
  Synthetic Construct
gagagcaguguguguugccugg

SEQ ID NO: 347 - RNA, 21 nt, Artificial Sequence
  Synthetic Construct
auccccagauacaauggacaa

SEQ ID NO: 348 - RNA, 20 nt, Artificial Sequence
  Synthetic Construct
uaggaugggggugagaggug

SEQ ID NO: 349 - RNA, 21 nt, Artificial Sequence
  Synthetic Construct
aucacauugccagggauuucc

SEQ ID NO: 350 - RNA, 21 nt, Artificial Sequence
  Synthetic Construct
aucacauugccagggauuacc

SEQ ID NO: 351 - RNA, 22 nt, Artificial Sequence
  Synthetic Construct
aucacauugccagugauuaccc

SEQ ID NO: 352 - RNA, 22 nt, Artificial Sequence
  Synthetic Construct
uggcucaguucagcaggaacag

SEQ ID NO: 353 - RNA, 22 nt, Artificial Sequence
  Synthetic Construct
uggcucaguucagcaggaacag

SEQ ID NO: 354 - RNA, 22 nt, Artificial Sequence
  Synthetic Construct
agcagaggcagagaggcucagg

SEQ ID NO: 355 - RNA, 21 nt, Artificial Sequence
  Synthetic Construct
aggcggagacuugggcaauug

SEQ ID NO: 356 - RNA, 22 nt, Artificial Sequence
  Synthetic Construct
guuuuaccaccuccaggagacu

SEQ ID NO: 357 - RNA, 22 nt, Artificial Sequence
  Synthetic Construct
cgccucuucagcgcugucuucc

SEQ ID NO: 358 - RNA, 22 nt, Artificial Sequence
  Synthetic Construct
uucaaguaauccaggauaggcu

SEQ ID NO: 359 - RNA, 22 nt, Artificial Sequence
  Synthetic Construct
uucaaguaauccaggauaggcu

SEQ ID NO: 360 - RNA, 21 nt, Artificial Sequence
  Synthetic Construct
uucaaguaauucaggauaggu

SEQ ID NO: 361 - RNA, 21 nt, Artificial Sequence
  Synthetic Construct
uucacaguggcuaaguuccgc

SEQ ID NO: 362 - RNA, 21 nt, Artificial Sequence
  Synthetic Construct
uucacaguggcuaaguucugc

SEQ ID NO: 363 - RNA, 22 nt, Artificial Sequence
  Synthetic Construct
cacuagauugugagcuccugga

SEQ ID NO: 364 - RNA, 19 nt, Artificial Sequence
  Synthetic Construct
ggggccuggcggugggcgg

SEQ ID NO: 365 - RNA, 21 nt, Artificial Sequence
  Synthetic Construct
guuagggccaacaucucuugg

SEQ ID NO: 366 - RNA, 22 nt, Artificial Sequence
  Synthetic Construct
gaggguuggguggaggcucucc

SEQ ID NO: 367 - RNA, 21 nt, Artificial Sequence
  Synthetic Construct
auguaugugugcaugugcaug

SEQ ID NO: 368 - RNA, 24 nt, Artificial Sequence
  Synthetic Construct
agcagaagcagggagguucuccca

SEQ ID NO: 369 - RNA, 22 nt, Artificial Sequence
  Synthetic Construct
ugguuuaccgucccacauacau

SEQ ID NO: 370 - RNA, 22 nt, Artificial Sequence
  Synthetic Construct
acugauuucuuuugguguucag

SEQ ID NO: 371 - RNA, 23 nt, Artificial Sequence
  Synthetic Construct
uagcaccauuugaaaucaguguu

SEQ ID NO: 372 - RNA, 23 nt, Artificial Sequence
  Synthetic Construct
uagcaccauuugaaaucaguguu

SEQ ID NO: 373 - RNA, 22 nt, Artificial Sequence
  Synthetic Construct
ugaccgauuucuccugguguuc

SEQ ID NO: 374 - RNA, 22 nt, Artificial Sequence
  Synthetic Construct
uauacaagggcagacucucucu

SEQ ID NO: 375 - RNA, 22 nt, Artificial Sequence
  Synthetic Construct
gcucugacuuuauugcacuacu

SEQ ID NO: 376 - RNA, 23 nt, Artificial Sequence
  Synthetic Construct
cagugcaaugauauugucaaagc

SEQ ID NO: 377 - RNA, 23 nt, Artificial Sequence
  Synthetic Construct
uaagugcuuccauguuuugguga

SEQ ID NO: 378 - RNA, 23 nt, Artificial Sequence
  Synthetic Construct
uaagugcuuccauguuuuaguag

SEQ ID NO: 379 - RNA, 22 nt, Artificial Sequence
  Synthetic Construct
uuuaacauggggguaccugcug

SEQ ID NO: 380 - RNA, 22 nt, Artificial Sequence
  Synthetic Construct
acuuuaacauggaggcacuugc

SEQ ID NO: 381 - RNA, 17 nt, Artificial Sequence
  Synthetic Construct
uaagugcuuccaugcuu

SEQ ID NO: 382 - RNA, 17 nt, Artificial Sequence
  Synthetic Construct
uaauugcuuccauguuu

SEQ ID NO: 383 - RNA, 23 nt, Artificial Sequence
  Synthetic Construct
uugccacacugcaacaccuuaca

SEQ ID NO: 384 - RNA, 23 nt, Artificial Sequence
  Synthetic Construct
ucagcaccaggauauuguuggag

SEQ ID NO: 385 - RNA, 22 nt, Artificial Sequence
  Synthetic Construct
gauaucagcucaguaggcaccg

SEQ ID NO: 386 - RNA, 22 nt, Artificial Sequence
  Synthetic Construct
cuuucagucggauguuugcagc

SEQ ID NO: 387 - RNA, 22 nt, Artificial Sequence
  Synthetic Construct
uguaaacauccuacacucagcu

SEQ ID NO: 388 - RNA, 23 nt, Artificial Sequence
  Synthetic Construct
uguaaacauccuacacucucagc

SEQ ID NO: 389 - RNA, 23 nt, Artificial Sequence
  Synthetic Construct
uguaaacauccuacacucucagc

SEQ ID NO: 390 - RNA, 22 nt, Artificial Sequence
  Synthetic Construct
uguaaacauccccgacuggaag

SEQ ID NO: 391 - RNA, 22 nt, Artificial Sequence
  Synthetic Construct
uguaaacauccuugacuggaag

SEQ ID NO: 392 - RNA, 22 nt, Artificial Sequence
  Synthetic Construct
ugcuaugccaacauauugccau

SEQ ID NO: 393 - RNA, 20 nt, Artificial Sequence
  Synthetic Construct
auauggguuuacuaguuggu

SEQ ID NO: 394 - RNA, 22 nt, Artificial Sequence
  Synthetic Construct
ugccuggaacauaguagggacu

SEQ ID NO: 395 - RNA, 21 nt, Artificial Sequence
  Synthetic Construct
auaggacucauauagugccag

SEQ ID NO: 396 - RNA, 23 nt, Artificial Sequence
  Synthetic Construct
ugugacugcauuaugaaaauucu

SEQ ID NO: 397 - RNA, 20 nt, Artificial Sequence
  Synthetic Construct
uggcuuuuaacuuugauggc

SEQ ID NO: 398 - RNA, 21 nt, Artificial Sequence
  Synthetic Construct
ccugucugugccugcuguaca

SEQ ID NO: 399 - RNA, 22 nt, Artificial Sequence
  Synthetic Construct
uccuuugccuauucuauuuaag

SEQ ID NO: 400 - RNA, 22 nt, Artificial Sequence
  Synthetic Construct
guugggacaagaggacggucuu

SEQ ID NO: 401 - RNA, 17 nt, Artificial Sequence
  Synthetic Construct
cagagaauuguuuaauc

SEQ ID NO: 402 - RNA, 21 nt, Artificial Sequence
  Synthetic Construct
uucgcgggcgaaggcaaaguc

SEQ ID NO: 403 - RNA, 20 nt, Artificial Sequence
  Synthetic Construct
uagaggaagcuguggagaga

SEQ ID NO: 404 - RNA, 22 nt, Artificial Sequence
  Synthetic Construct
caucuggcauccgucacacaga

SEQ ID NO: 405 - RNA, 22 nt, Artificial Sequence
  Synthetic Construct
uccccuucugcaggccugcugg

SEQ ID NO: 406 - RNA, 23 nt, Artificial Sequence
  Synthetic Construct
ucuggcaaguaaaaaacucucau

SEQ ID NO: 407 - RNA, 22 nt, Artificial Sequence
  Synthetic Construct
gcaguaguguagagauugguuu

SEQ ID NO: 408 - RNA, 21 nt, Artificial Sequence
  Synthetic Construct
gcugcaccggagacuggguaa

SEQ ID NO: 409 - RNA, 23 nt, Artificial Sequence
  Synthetic Construct
ucgaggacugguggaagggccuu

SEQ ID NO: 410 - RNA, 24 nt, Artificial Sequence
  Synthetic Construct
uggguagagaaggagcucagagga

SEQ ID NO: 411 - RNA, 22 nt, Artificial Sequence
  Synthetic Construct
uaaagaacucuuaaaacccaau

SEQ ID NO: 412 - RNA, 23 nt, Artificial Sequence
  Synthetic Construct
ugauggauaaaagacuacauauu

SEQ ID NO: 413 - RNA, 22 nt, Artificial Sequence
  Synthetic Construct
ugccuaggcugagacugcagug

SEQ ID NO: 414 - RNA, 22 nt, Artificial Sequence
  Synthetic Construct
ggcuggagcgagugcaguggug

SEQ ID NO: 415 - RNA, 23 nt, Artificial Sequence
  Synthetic Construct
cugacugaauagguagggucauu

SEQ ID NO: 416 - RNA, 24 nt, Artificial Sequence
  Synthetic Construct
ucuguagccugggagcaauggggu

SEQ ID NO: 417 - RNA, 24 nt, Artificial Sequence
  Synthetic Construct
uguggacagugagguagagggagu

SEQ ID NO: 418 - RNA, 23 nt, Artificial Sequence
  Synthetic Construct
uaggagcucaacagaugccuguu

SEQ ID NO: 419 - RNA, 21 nt, Artificial Sequence
  Synthetic Construct
accugaauuaccaaaagcuuu

SEQ ID NO: 420 - RNA, 19 nt, Artificial Sequence
  Synthetic Construct
gagggcggguggaggagga

SEQ ID NO: 421 - RNA, 22 nt, Artificial Sequence
  Synthetic Construct
aaggccuuucugaaccuucaga

SEQ ID NO: 422 - RNA, 25 nt, Artificial Sequence
  Synthetic Construct
auaacauuguaaagcgcuucuuucg

SEQ ID NO: 423 - RNA, 22 nt, Artificial Sequence
  Synthetic Construct
auauaccuguucggucucuuua

SEQ ID NO: 424 - RNA, 24 nt, Artificial Sequence
  Synthetic Construct
agauauuuugaguguuuggaauug

SEQ ID NO: 425 - RNA, 22 nt, Artificial Sequence
  Synthetic Construct
caugcuaggauagaaagaaugg

SEQ ID NO: 426 - RNA, 24 nt, Artificial Sequence
  Synthetic Construct
gguugggcagugaggaggguguga

SEQ ID NO: 427 - RNA, 22 nt, Artificial Sequence
  Synthetic Construct
uggaaaaaacuggugugugcuu

SEQ ID NO: 428 - RNA, 23 nt, Artificial Sequence
  Synthetic Construct
uuuguauggauauguguguguau

SEQ ID NO: 429 - RNA, 22 nt, Artificial Sequence
  Synthetic Construct
caaccucgacgaucuccucagc

SEQ ID NO: 430 - RNA, 22 nt, Artificial Sequence
  Synthetic Construct
caaccucgaggaucuccccagc

SEQ ID NO: 431 - RNA, 21 nt, Artificial Sequence
  Synthetic Construct
gguggggcaaugggaucaggu

SEQ ID NO: 432 - RNA, 22 nt, Artificial Sequence
  Synthetic Construct
auugccucuguucuaacacaag

SEQ ID NO: 433 - RNA, 23 nt, Artificial Sequence
  Synthetic Construct
ggggaaagcgaguagggacauuu

SEQ ID NO: 434 - RNA, 22 nt, Artificial Sequence
  Synthetic Construct
cagaaggggaguugggagcaga

SEQ ID NO: 435 - RNA, 21 nt, Artificial Sequence
  Synthetic Construct
ccaggcucugcagugggaacu

SEQ ID NO: 436 - RNA, 18 nt, Artificial Sequence
  Synthetic Construct
ccaggcucugcaguggga

SEQ ID NO: 437 - RNA, 21 nt, Artificial Sequence
  Synthetic Construct
cucccacuuccagaucuuucu

SEQ ID NO: 438 - RNA, 22 nt, Artificial Sequence
  Synthetic Construct
cugcccuagucuagcugaagcu

SEQ ID NO: 439 - RNA, 22 nt, Artificial Sequence
  Synthetic Construct
aagggcuuccucucugcaggac

SEQ ID NO: 440 - RNA, 22 nt, Artificial Sequence
  Synthetic Construct
uaggauuacaagugucggccac

SEQ ID NO: 441 - RNA, 22 nt, Artificial Sequence
  Synthetic Construct
agagcugagacuagaaagccca

SEQ ID NO: 442 - RNA, 23 nt, Artificial Sequence
  Synthetic Construct
cugauaagaacagaggcccagau

SEQ ID NO: 443 - RNA, 23 nt, Artificial Sequence
  Synthetic Construct
uuagggaguagaaggguggggag

SEQ ID NO: 444 - RNA, 22 nt, Artificial Sequence
  Synthetic Construct
uauaaaaugagggcaguaagac

SEQ ID NO: 445 - RNA, 22 nt, Artificial Sequence
  Synthetic Construct
ugugacuuuaagggaaauggcg

SEQ ID NO: 446 - RNA, 22 nt, Artificial Sequence
  Synthetic Construct
agguggaugcaaugugaccuca

SEQ ID NO: 447 - RNA, 23 nt, Artificial Sequence
  Synthetic Construct
cgcagacaaugccuacuggccua

SEQ ID NO: 448 - RNA, 22 nt, Artificial Sequence
  Synthetic Construct
aggauuucagaaauacuggugu

SEQ ID NO: 449 - RNA, 17 nt, Artificial Sequence
  Synthetic Construct
gaguucuacagucagac

SEQ ID NO: 450 - RNA, 22 nt, Artificial Sequence
  Synthetic Construct
uaggacugugcuuggcacauag

SEQ ID NO: 451 - RNA, 22 nt, Artificial Sequence
  Synthetic Construct
cugggguucugagacagacagu

SEQ ID NO: 452 - RNA, 24 nt, Artificial Sequence
  Synthetic Construct
agauguauggaaucuguauauauc

SEQ ID NO: 453 - RNA, 22 nt, Artificial Sequence
  Synthetic Construct
aaaggaggaaauaggcaggcca

SEQ ID NO: 454 - RNA, 23 nt, Artificial Sequence
  Synthetic Construct
uagugaguuagagaugcagagcc

SEQ ID NO: 455 - RNA, 22 nt, Artificial Sequence
  Synthetic Construct
cggggagagaacgcagugacgu

SEQ ID NO: 456 - RNA, 19 nt, Artificial Sequence
  Synthetic Construct
acuggccugggacuaccgg

SEQ ID NO: 457 - RNA, 23 nt, Artificial Sequence
  Synthetic Construct
uguguacacacgugccaggcgcu

SEQ ID NO: 458 - RNA, 17 nt, Artificial Sequence
  Synthetic Construct
ggggcgcggccggaucg

SEQ ID NO: 459 - RNA, 22 nt, Artificial Sequence
  Synthetic Construct
agaaggggugaaauuuaaacgu

SEQ ID NO: 460 - RNA, 25 nt, Artificial Sequence
  Synthetic Construct
cuuccagacgcuccgccccacgucg

SEQ ID NO: 461 - RNA, 19 nt, Artificial Sequence
  Synthetic Construct
aucgggcccucggcgccgg

SEQ ID NO: 462 - RNA, 17 nt, Artificial Sequence
  Synthetic Construct
gcuucuguaguguaguc

SEQ ID NO: 463 - RNA, 22 nt, Artificial Sequence
  Synthetic Construct
gccucucucggagucgcucgga

SEQ ID NO: 464 - RNA, 23 nt, Artificial Sequence
  Synthetic Construct
aaagucucgcucucugccccuca

SEQ ID NO: 465 - RNA, 23 nt, Artificial Sequence
  Synthetic Construct
agaagaaggcggucggucugcgg

SEQ ID NO: 466 - RNA, 22 nt, Artificial Sequence
  Synthetic Construct
caggcgucugucuacguggcuu

SEQ ID NO: 467 - RNA, 20 nt, Artificial Sequence
  Synthetic Construct
uuggccauggggcugcgcgg

SEQ ID NO: 468 - RNA, 23 nt, Artificial Sequence
  Synthetic Construct
agaggcuuugugcggauacgggg

SEQ ID NO: 469 - RNA, 21 nt, Artificial Sequence
  Synthetic Construct
cccuugggucugaugggguag

SEQ ID NO: 470 - RNA, 23 nt, Artificial Sequence
  Synthetic Construct
uguggaagguagacggccagaga

SEQ ID NO: 471 - RNA, 22 nt, Artificial Sequence
  Synthetic Construct
cucucuggccgucuaccuucca

SEQ ID NO: 472 - RNA, 23 nt, Artificial Sequence
  Synthetic Construct
ucugggagguuguagcaguggaa

SEQ ID NO: 473 - RNA, 22 nt, Artificial Sequence
  Synthetic Construct
uccugcguaggaucugaggagu

SEQ ID NO: 474 - RNA, 22 nt, Artificial Sequence
  Synthetic Construct
agcucugcugcucacuggcagu

SEQ ID NO: 475 - RNA, 17 nt, Artificial Sequence
  Synthetic Construct
cgcgccgggcccggguu

SEQ ID NO: 476 - RNA, 18 nt, Artificial Sequence
  Synthetic Construct
cggggcggcaggggccuc

SEQ ID NO: 477 - RNA, 23 nt, Artificial Sequence
  Synthetic Construct
ggaggcgcaggcucggaaaggcg

SEQ ID NO: 478 - RNA, 22 nt, Artificial Sequence
  Synthetic Construct
guggaguccuggggaauggaga

SEQ ID NO: 479 - RNA, 23 nt, Artificial Sequence
  Synthetic Construct
agggacugccuuaggagaaaguu

SEQ ID NO: 480 - RNA, 22 nt, Artificial Sequence
  Synthetic Construct
caauuuagugugugugauauuu

SEQ ID NO: 481 - RNA, 22 nt, Artificial Sequence
  Synthetic Construct
caccuugcgcuacucaggucug

SEQ ID NO: 482 - RNA, 17 nt, Artificial Sequence
  Synthetic Construct
gggauaugaagaaaaau

SEQ ID NO: 483 - RNA, 22 nt, Artificial Sequence
  Synthetic Construct
uggaagggagaagagcuuuaau

SEQ ID NO: 484 - RNA, 22 nt, Artificial Sequence
  Synthetic Construct
aaaagcuggguugagagggcga

SEQ ID NO: 485 - RNA, 22 nt, Artificial Sequence
  Synthetic Construct
aaaagcuggguugagagggcaa

SEQ ID NO: 486 - RNA, 20 nt, Artificial Sequence
  Synthetic Construct
aaaagcuggguugagagggu

SEQ ID NO: 487 - RNA, 19 nt, Artificial Sequence
  Synthetic Construct
aaaagcuggguugagagga

SEQ ID NO: 488 - RNA, 18 nt, Artificial Sequence
  Synthetic Construct
aaagcuggguugagaagg

SEQ ID NO: 489 - RNA, 22 nt, Artificial Sequence
  Synthetic Construct
aggugguccguggcgcguucgc

SEQ ID NO: 490 - RNA, 23 nt, Artificial Sequence
  Synthetic Construct
agguuguccguggugaguucgca

SEQ ID NO: 491 - RNA, 23 nt, Artificial Sequence
  Synthetic Construct
cgcauccccuagggcauuggugu

SEQ ID NO: 492 - RNA, 23 nt, Artificial Sequence
  Synthetic Construct
ccuaguagguguccaguaagugu

SEQ ID NO: 493 - RNA, 20 nt, Artificial Sequence
  Synthetic Construct
ccucugggcccuuccuccag

SEQ ID NO: 494 - RNA, 22 nt, Artificial Sequence
  Synthetic Construct
cuggcccucucugcccuuccgu

SEQ ID NO: 495 - RNA, 22 nt, Artificial Sequence
  Synthetic Construct
aacacaccugguuaaccucuuu

SEQ ID NO: 496 - RNA, 23 nt, Artificial Sequence
  Synthetic Construct
gcaaagcacacggccugcagaga

SEQ ID NO: 497 - RNA, 22 nt, Artificial Sequence
  Synthetic Construct
cuagguauggucccagggaucc

SEQ ID NO: 498 - RNA, 23 nt, Artificial Sequence
  Synthetic Construct
ucaagagcaauaacgaaaaaugu

SEQ ID NO: 499 - RNA, 21 nt, Artificial Sequence
  Synthetic Construct
gaacggcuucauacaggaguu

SEQ ID NO: 500 - RNA, 22 nt, Artificial Sequence
  Synthetic Construct
uccagcaucagugauuuuguug

SEQ ID NO: 501 - RNA, 23 nt, Artificial Sequence
  Synthetic Construct
ugagcgccucgacgacagagccg

SEQ ID NO: 502 - RNA, 21 nt, Artificial Sequence
  Synthetic Construct
gugcauuguaguugcauugca

SEQ ID NO: 503 - RNA, 20 nt, Artificial Sequence
  Synthetic Construct
gugcauugcuguugcauugc

SEQ ID NO: 504 - RNA, 22 nt, Artificial Sequence
  Synthetic Construct
uccgucucaguuacuuuauagc

SEQ ID NO: 505 - RNA, 23 nt, Artificial Sequence
  Synthetic Construct
ucucacacagaaaucgcacccgu

SEQ ID NO: 506 - RNA, 22 nt, Artificial Sequence
  Synthetic Construct
gcccugaacgaggggucuggag

SEQ ID NO: 507 - RNA, 23 nt, Artificial Sequence
  Synthetic Construct
ugucugcccgcaugccugccucu

SEQ ID NO: 508 - RNA, 22 nt, Artificial Sequence
  Synthetic Construct
uggcagugucuuagcugguugu

SEQ ID NO: 509 - RNA, 23 nt, Artificial Sequence
  Synthetic Construct
uaggcagugucauuagcugauug

SEQ ID NO: 510 - RNA, 22 nt, Artificial Sequence
  Synthetic Construct
aaucacuaaccacacggccagg

SEQ ID NO: 511 - RNA, 24 nt, Artificial Sequence
  Synthetic Construct
aacaacaaaaucacuagucuucca

SEQ ID NO: 512 - RNA, 22 nt, Artificial Sequence
  Synthetic Construct
aaacaccauugucacacuccac

SEQ ID NO: 513 - RNA, 23 nt, Artificial Sequence
  Synthetic Construct
ccuccguguuaccuguccucuag

SEQ ID NO: 514 - RNA, 21 nt, Artificial Sequence
  Synthetic Construct
uuagugaaggcuauuuuaauu

SEQ ID NO: 515 - RNA, 20 nt, Artificial Sequence
  Synthetic Construct
acuguaaacgcuuucugaug

SEQ ID NO: 516 - RNA, 24 nt, Artificial Sequence
  Synthetic Construct
caaagugaugaguaauacuggcug

SEQ ID NO: 517 - RNA, 23 nt, Artificial Sequence
  Synthetic Construct
ucccccaggugugauucugauuu

SEQ ID NO: 518 - RNA, 20 nt, Artificial Sequence
  Synthetic Construct
gaaucggaaaggaggcgccg

SEQ ID NO: 519 - RNA, 21 nt, Artificial Sequence
  Synthetic Construct
uugugaagaaagaaauucuua

SEQ ID NO: 520 - RNA, 22 nt, Artificial Sequence
  Synthetic Construct
aggaggcaucuugagaaaugga

SEQ ID NO: 521 - RNA, 22 nt, Artificial Sequence
  Synthetic Construct
uguuguacuuuuuuuuuuguuc

SEQ ID NO: 522 - RNA, 23 nt, Artificial Sequence
  Synthetic Construct
ccacuuggaucugaaggcugccc

SEQ ID NO: 523 - RNA, 21 nt, Artificial Sequence
  Synthetic Construct
ucucucggcuccucgcggcuc

SEQ ID NO: 524 - RNA, 22 nt, Artificial Sequence
  Synthetic Construct
augaagugcacucaugauaugu

SEQ ID NO: 525 - RNA, 23 nt, Artificial Sequence
  Synthetic Construct
caucagcacccuauguccuuucu

SEQ ID NO: 526 - RNA, 22 nt, Artificial Sequence
  Synthetic Construct
ugucuacauuaaugaaaagagc

SEQ ID NO: 527 - RNA, 22 nt, Artificial Sequence
  Synthetic Construct
ucagcaggcaggcuggugcagc

SEQ ID NO: 528 - RNA, 22 nt, Artificial Sequence
  Synthetic Construct
aacacaccuauucaaggauuca

SEQ ID NO: 529 - RNA, 22 nt, Artificial Sequence
  Synthetic Construct
ucacccugcaucccgcacccag

SEQ ID NO: 530 - RNA, 20 nt, Artificial Sequence
  Synthetic Construct
cgcgggucggggucugcagg

SEQ ID NO: 531 - RNA, 22 nt, Artificial Sequence
  Synthetic Construct
ucaccugaccucccaugccugu

SEQ ID NO: 532 - RNA, 21 nt, Artificial Sequence
  Synthetic Construct
ucaccugagcucccgugccug

SEQ ID NO: 533 - RNA, 22 nt, Artificial Sequence
  Synthetic Construct
aauugcacgguauccaucugua

SEQ ID NO: 534 - RNA, 22 nt, Artificial Sequence
  Synthetic Construct
aaaaugaaaugagcccagccca

SEQ ID NO: 535 - RNA, 21 nt, Artificial Sequence
  Synthetic Construct
agccgcggggaucgccgaggg

SEQ ID NO: 536 - RNA, 19 nt, Artificial Sequence
  Synthetic Construct
agggaccugagugucuaag

SEQ ID NO: 537 - RNA, 19 nt, Artificial Sequence
  Synthetic Construct
aggugugucuguagagucc

SEQ ID NO: 538 - RNA, 24 nt, Artificial Sequence
  Synthetic Construct
cauagcccggucgcugguacauga

SEQ ID NO: 539 - RNA, 18 nt, Artificial Sequence
  Synthetic Construct
cggcuggaggugugagga

SEQ ID NO: 540 - RNA, 20 nt, Artificial Sequence
  Synthetic Construct
ccuccugaugauucuucuuc

SEQ ID NO: 541 - RNA, 19 nt, Artificial Sequence
  Synthetic Construct
gacuggacaagcugaggaa

SEQ ID NO: 542 - RNA, 21 nt, Artificial Sequence
  Synthetic Construct
gcuugucgcugcgguguugcu

SEQ ID NO: 543 - RNA, 17 nt, Artificial Sequence
  Synthetic Construct
ggcgggugcgggggugg

SEQ ID NO: 544 - RNA, 21 nt, Artificial Sequence
  Synthetic Construct
ugugucccauuauuggugauu

SEQ ID NO: 545 - RNA, 22 nt, Artificial Sequence
  Synthetic Construct
uuuaagaaaacaccauggagau

SEQ ID NO: 546 - RNA, 21 nt, Artificial Sequence
  Synthetic Construct
ugaguguugucuacgagggca

SEQ ID NO: 547 - RNA, 22 nt, Artificial Sequence
  Synthetic Construct
uaaugccccuaaaaauccuuau

SEQ ID NO: 548 - RNA, 22 nt, Artificial Sequence
  Synthetic Construct
uaaugccccuaaaaauccuuau

SEQ ID NO: 549 - RNA, 21 nt, Artificial Sequence
  Synthetic Construct
acugacaggagagcauuuuga

SEQ ID NO: 550 - RNA, 22 nt, Artificial Sequence
  Synthetic Construct
ugaccugggacucggacagcug

SEQ ID NO: 551 - RNA, 24 nt, Artificial Sequence
  Synthetic Construct
gaaaaugaugaguagugacugaug

SEQ ID NO: 552 - RNA, 23 nt, Artificial Sequence
  Synthetic Construct
ugagcaccacacaggccgggcgc

SEQ ID NO: 553 - RNA, 22 nt, Artificial Sequence
  Synthetic Construct
ucucaggaguaaagacagaguu

SEQ ID NO: 554 - RNA, 18 nt, Artificial Sequence
  Synthetic Construct
agcaggugcggggcggcg

SEQ ID NO: 555 - RNA, 21 nt, Artificial Sequence
  Synthetic Construct
cagugcaaguguagaugccga

SEQ ID NO: 556 - RNA, 22 nt, Artificial Sequence
  Synthetic Construct
accuuccucuccaugggucuuu

SEQ ID NO: 557 - RNA, 21 nt, Artificial Sequence
  Synthetic Construct
aauguagagauugaucaaaau

SEQ ID NO: 558 - RNA, 22 nt, Artificial Sequence
  Synthetic Construct
aauugcacuuuagcaaugguga

SEQ ID NO: 559 - RNA, 24 nt, Artificial Sequence
  Synthetic Construct
agagcucacagcuguccuucucua

SEQ ID NO: 560 - RNA, 22 nt, Artificial Sequence
  Synthetic Construct
aucaaauaaggacuagucugca

SEQ ID NO: 561 - RNA, 23 nt, Artificial Sequence
  Synthetic Construct
augagacucauguaaaacaucuu

SEQ ID NO: 562 - RNA, 22 nt, Artificial Sequence
  Synthetic Construct
auuguagaaccuaagauuggcc

SEQ ID NO: 563 - RNA, 22 nt, Artificial Sequence
  Synthetic Construct
caucucuaaggaacucccccaa

SEQ ID NO: 564 - RNA, 22 nt, Artificial Sequence
  Synthetic Construct
caguggccagagcccugcagug

SEQ ID NO: 565 - RNA, 22 nt, Artificial Sequence
  Synthetic Construct
cugcagaguuuguacggaccgg

SEQ ID NO: 566 - RNA, 22 nt, Artificial Sequence
  Synthetic Construct
cuuccccccaguaaucuucauc

SEQ ID NO: 567 - RNA, 22 nt, Artificial Sequence
  Synthetic Construct
gacucacucacaggauugugca

SEQ ID NO: 568 - RNA, 22 nt, Artificial Sequence
  Synthetic Construct
uaguggaugaugcacucugugc

SEQ ID NO: 569 - RNA, 22 nt, Artificial Sequence
  Synthetic Construct
cuacuucuaccuguguuaucau

SEQ ID NO: 570 - RNA, 22 nt, Artificial Sequence
  Synthetic Construct
ugcgacauuggaaguaguauca

SEQ ID NO: 571 - RNA, 21 nt, Artificial Sequence
  Synthetic Construct
uuagaccuaguacacguccuu

SEQ ID NO: 572 - RNA, 22 nt, Artificial Sequence
  Synthetic Construct
uuuccuacccuaccugaagacu

SEQ ID NO: 573 - RNA, 22 nt, Artificial Sequence
  Synthetic Construct
aucuguaagagaaaguaaauga

SEQ ID NO: 574 - RNA, 24 nt, Artificial Sequence
  Synthetic Construct
cccggacaggcguucgugcgacgu

SEQ ID NO: 575 - RNA, 22 nt, Artificial Sequence
  Synthetic Construct
uauggaaagacuuugccacucu

SEQ ID NO: 576 - RNA, 22 nt, Artificial Sequence
  Synthetic Construct
cugggaggugugauaucguggu

SEQ ID NO: 577 - RNA, 22 nt, Artificial Sequence
  Synthetic Construct
cugggaggugugauauuguggu

SEQ ID NO: 578 - RNA, 22 nt, Artificial Sequence
  Synthetic Construct
cugggaggugugauauuguggu

SEQ ID NO: 579 - RNA, 22 nt, Artificial Sequence
  Synthetic Construct
gggaggugugaucucacacucg

SEQ ID NO: 580 - RNA, 22 nt, Artificial Sequence
  Synthetic Construct
ugugauaucaugguuccuggga

SEQ ID NO: 581 - RNA, 22 nt, Artificial Sequence
  Synthetic Construct
ugugauaucgugcuuccuggga

SEQ ID NO: 582 - RNA, 21 nt, Artificial Sequence
  Synthetic Construct
aauaauacaugguugaucuuu

SEQ ID NO: 583 - RNA, 23 nt, Artificial Sequence
  Synthetic Construct
accuggacccagcguagacaaag

SEQ ID NO: 584 - RNA, 23 nt, Artificial Sequence
  Synthetic Construct
aguggaugauggagacucgguac

SEQ ID NO: 585 - RNA, 24 nt, Artificial Sequence
  Synthetic Construct
guuccacacugacacugcagaagu

SEQ ID NO: 586 - RNA, 22 nt, Artificial Sequence
  Synthetic Construct
gccugcugggguggaaccuggu

SEQ ID NO: 587 - RNA, 20 nt, Artificial Sequence
  Synthetic Construct
gguauccguuuggggauggu

SEQ ID NO: 588 - RNA, 22 nt, Artificial Sequence
  Synthetic Construct
gaaggcagcagugcuccccugu

SEQ ID NO: 589 - RNA, 20 nt, Artificial Sequence
  Synthetic Construct
acucaaacugugggggcacu

SEQ ID NO: 590 - RNA, 22 nt, Artificial Sequence
  Synthetic Construct
acucaaaagauggcggcacuuu

SEQ ID NO: 591 - RNA, 23 nt, Artificial Sequence
  Synthetic Construct
ccucaaauguggagcacuauucu

SEQ ID NO: 592 - RNA, 23 nt, Artificial Sequence
  Synthetic Construct
gaagugcuucgauuuuggggugu

SEQ ID NO: 593 - RNA, 22 nt, Artificial Sequence
  Synthetic Construct
uuauaauacaaccugauaagug

SEQ ID NO: 594 - RNA, 22 nt, Artificial Sequence
  Synthetic Construct
cuuagcagguuguauuaucauu

SEQ ID NO: 595 - RNA, 22 nt, Artificial Sequence
  Synthetic Construct
cacuuagcagguuguauuauau

SEQ ID NO: 596 - RNA, 22 nt, Artificial Sequence
  Synthetic Construct
uuuguucguucggcucgcguga

SEQ ID NO: 597 - RNA, 21 nt, Artificial Sequence
  Synthetic Construct
aucauagaggaaaauccacgu

SEQ ID NO: 598 - RNA, 21 nt, Artificial Sequence
  Synthetic Construct
aucauagaggaaaauccacgu

SEQ ID NO: 599 - RNA, 22 nt, Artificial Sequence
  Synthetic Construct
cguggauauuccuucuauguuu

SEQ ID NO: 600 - RNA, 21 nt, Artificial Sequence
  Synthetic Construct
gguggauauuccuucuauguu

SEQ ID NO: 601 - RNA, 22 nt, Artificial Sequence
  Synthetic Construct
agagguugcccuuggugaauuc

SEQ ID NO: 602 - RNA, 22 nt, Artificial Sequence
  Synthetic Construct
cuccugacuccagguccugugu

SEQ ID NO: 603 - RNA, 19 nt, Artificial Sequence
  Synthetic Construct
acuggacuuggaggcagaa

SEQ ID NO: 604 - RNA, 25 nt, Artificial Sequence
  Synthetic Construct
acuggacuuggagucagaagagugg

SEQ ID NO: 605 - RNA, 20 nt, Artificial Sequence
  Synthetic Construct
acuggacuuggagucagaaa

SEQ ID NO: 606 - RNA, 19 nt, Artificial Sequence
  Synthetic Construct
acuggacuuggagucagga

SEQ ID NO: 607 - RNA, 20 nt, Artificial Sequence
  Synthetic Construct
acuggacuuggagccagaag

SEQ ID NO: 608 - RNA, 20 nt, Artificial Sequence
  Synthetic Construct
acugggcuuggagucagaag

SEQ ID NO: 609 - RNA, 21 nt, Artificial Sequence
  Synthetic Construct
acuggacuuggugucagaugg

SEQ ID NO: 610 - RNA, 21 nt, Artificial Sequence
  Synthetic Construct
acuggacuaggagucagaagg

SEQ ID NO: 611 - RNA, 19 nt, Artificial Sequence
  Synthetic Construct
acuggauuuggagccagaa

SEQ ID NO: 612 - RNA, 21 nt, Artificial Sequence
  Synthetic Construct
ugguagacuauggaacguagg

SEQ ID NO: 613 - RNA, 22 nt, Artificial Sequence
  Synthetic Construct
ugguugaccauagaacaugcgc

SEQ ID NO: 614 - RNA, 22 nt, Artificial Sequence
  Synthetic Construct
agcgagguugcccuuuguauau

SEQ ID NO: 615 - RNA, 21 nt, Artificial Sequence
  Synthetic Construct
aaucauucacggacaacacuu

SEQ ID NO: 616 - RNA, 19 nt, Artificial Sequence
  Synthetic Construct
acagcacugccuggucaga

SEQ ID NO: 617 - RNA, 20 nt, Artificial Sequence
  Synthetic Construct
auuccuagaaauuguucaua

SEQ ID NO: 618 - RNA, 22 nt, Artificial Sequence
  Synthetic Construct
aggugcuccaggcuggcucaca

SEQ ID NO: 619 - RNA, 22 nt, Artificial Sequence
  Synthetic Construct
gagcaauguagguagacuguuu

SEQ ID NO: 620 - RNA, 22 nt, Artificial Sequence
  Synthetic Construct
uguccucuagggccugcagucu

SEQ ID NO: 621 - RNA, 20 nt, Artificial Sequence
  Synthetic Construct
aaaggcauaaaaccaagaca

SEQ ID NO: 622 - RNA, 22 nt, Artificial Sequence
  Synthetic Construct
uguguggauccuggaggaggca

SEQ ID NO: 623 - RNA, 21 nt, Artificial Sequence
  Synthetic Construct
uaacgcauaauauggacaugu

SEQ ID NO: 624 - RNA, 22 nt, Artificial Sequence
  Synthetic Construct
uuugggacugaucuugaugucu

SEQ ID NO: 625 - RNA, 22 nt, Artificial Sequence
  Synthetic Construct
aaggaaccagaaaaugagaagu

SEQ ID NO: 626 - RNA, 22 nt, Artificial Sequence
  Synthetic Construct
uugaggaaaagauggucuuauu

SEQ ID NO: 627 - RNA, 26 nt, Artificial Sequence
  Synthetic Construct
aagaggaagaaauggcugguucucag

SEQ ID NO: 628 - RNA, 20 nt, Artificial Sequence
  Synthetic Construct
gcucggacugagcagguggg

SEQ ID NO: 629 - RNA, 21 nt, Artificial Sequence
  Synthetic Construct
acagggccgcagauggagacu

SEQ ID NO: 630 - RNA, 21 nt, Artificial Sequence
  Synthetic Construct
gcagagaacaaaggacucagu

SEQ ID NO: 631 - RNA, 22 nt, Artificial Sequence
  Synthetic Construct
acugauuaucuuaacucucuga

SEQ ID NO: 632 - RNA, 23 nt, Artificial Sequence
  Synthetic Construct
ucucugaguaccauaugccuugu

SEQ ID NO: 633 - RNA, 22 nt, Artificial Sequence
  Synthetic Construct
ucuggccuugacuugacucuuu

SEQ ID NO: 634 - RNA, 22 nt, Artificial Sequence
  Synthetic Construct
aacuaguaauguuggauuaggg

SEQ ID NO: 635 - RNA, 22 nt, Artificial Sequence
  Synthetic Construct
auauguauaugugacugcuacu

SEQ ID NO: 636 - RNA, 22 nt, Artificial Sequence
  Synthetic Construct
aagagaacugaaaguggagccu

SEQ ID NO: 637 - RNA, 21 nt, Artificial Sequence
  Synthetic Construct
uggccaaaaagcaggcagaga

SEQ ID NO: 638 - RNA, 22 nt, Artificial Sequence
  Synthetic Construct
cagguagauauuugauaggcau

SEQ ID NO: 639 - RNA, 23 nt, Artificial Sequence
  Synthetic Construct
ugaagcucuaagguuccgccugc

SEQ ID NO: 640 - RNA, 23 nt, Artificial Sequence
  Synthetic Construct
gaggcugaugugaguagaccacu

SEQ ID NO: 641 - RNA, 22 nt, Artificial Sequence
  Synthetic Construct
ucagguguggaaacugaggcag

SEQ ID NO: 642 - RNA, 22 nt, Artificial Sequence
  Synthetic Construct
uguagauacgagcaccagccac

SEQ ID NO: 643 - RNA, 22 nt, Artificial Sequence
  Synthetic Construct
uaagggguguauggcagaugca

SEQ ID NO: 644 - RNA, 23 nt, Artificial Sequence
  Synthetic Construct
acaggcggcuguagcaauggggg

SEQ ID NO: 645 - RNA, 22 nt, Artificial Sequence
  Synthetic Construct
aauucccuuguagauaacccgg

SEQ ID NO: 646 - RNA, 22 nt, Artificial Sequence
  Synthetic Construct
uacgcgcagaccacaggauguc

SEQ ID NO: 647 - RNA, 20 nt, Artificial Sequence
  Synthetic Construct
guggguuggggcgggcucug

SEQ ID NO: 648 - RNA, 22 nt, Artificial Sequence
  Synthetic Construct
uuacacacaacugaggaucaua

SEQ ID NO: 649 - RNA, 22 nt, Artificial Sequence
  Synthetic Construct
aagcaauacuguuaccugaaau

SEQ ID NO: 650 - RNA, 23 nt, Artificial Sequence
  Synthetic Construct
uagcccccaggcuucacuuggcg

SEQ ID NO: 651 - RNA, 23 nt, Artificial Sequence
  Synthetic Construct
uucgggcuggccugcugcuccgg

SEQ ID NO: 652 - RNA, 23 nt, Artificial Sequence
  Synthetic Construct
agggcauaggagaggguugauau

SEQ ID NO: 653 - RNA, 20 nt, Artificial Sequence
  Synthetic Construct
ggcggcggcggaggcggggg

SEQ ID NO: 654 - RNA, 22 nt, Artificial Sequence
  Synthetic Construct
cugccagccccguuccagggca

SEQ ID NO: 655 - RNA, 23 nt, Artificial Sequence
  Synthetic Construct
acaaaguacagcauuagccuuag

SEQ ID NO: 656 - RNA, 23 nt, Artificial Sequence
  Synthetic Construct
aaaggucauuguaagguuaaugc

SEQ ID NO: 657 - RNA, 22 nt, Artificial Sequence
  Synthetic Construct
ugaggcuaaugcacuacuucac

SEQ ID NO: 658 - RNA, 24 nt, Artificial Sequence
  Synthetic Construct
uauagagagcaggaagauuaaugu

SEQ ID NO: 659 - RNA, 23 nt, Artificial Sequence
  Synthetic Construct
gugcuucaucguaauuaaccuua

SEQ ID NO: 660 - RNA, 24 nt, Artificial Sequence
  Synthetic Construct
guggaaagcaugcauccagggugu

SEQ ID NO: 661 - RNA, 22 nt, Artificial Sequence
  Synthetic Construct
gaauguugcucggugaaccccu

SEQ ID NO: 662 - RNA, 21 nt, Artificial Sequence
  Synthetic Construct
agguugucugugaugaguucg

SEQ ID NO: 663 - RNA, 22 nt, Artificial Sequence
  Synthetic Construct
uauguaacacgguccacuaacc

SEQ ID NO: 664 - RNA, 23 nt, Artificial Sequence
  Synthetic Construct
uggucgaccaguuggaaaguaau

SEQ ID NO: 665 - RNA, 23 nt, Artificial Sequence
  Synthetic Construct
aucaacagacauuaauugggcgc

SEQ ID NO: 666 - RNA, 22 nt, Artificial Sequence
  Synthetic Construct
acuggacuuagggucagaaggc

SEQ ID NO: 667 - RNA, 23 nt, Artificial Sequence
  Synthetic Construct
ugaggggcagagagcgagacuuu

SEQ ID NO: 668 - RNA, 22 nt, Artificial Sequence
  Synthetic Construct
cagcagcaauucauguuuugaa

SEQ ID NO: 669 - RNA, 22 nt, Artificial Sequence
  Synthetic Construct
aucgggaaugucguguccgccc

SEQ ID NO: 670 - RNA, 17 nt, Artificial Sequence
  Synthetic Construct
ccugagaaaagggccaa

SEQ ID NO: 671 - RNA, 19 nt, Artificial Sequence
  Synthetic Construct
ggccacugagucagcacca

SEQ ID NO: 672 - RNA, 18 nt, Artificial Sequence
  Synthetic Construct
agggcauguccagggggu

SEQ ID NO: 673 - RNA, 23 nt, Artificial Sequence
  Synthetic Construct
gccuggagcuacuccaccaucuc

SEQ ID NO: 674 - RNA, 17 nt, Artificial Sequence
  Synthetic Construct
caguguucagagaugga

SEQ ID NO: 675 - RNA, 18 nt, Artificial Sequence
  Synthetic Construct
aucugaccugaugaaggu

SEQ ID NO: 676 - RNA, 18 nt, Artificial Sequence
  Synthetic Construct
ccagagguggggacugag

SEQ ID NO: 677 - RNA, 17 nt, Artificial Sequence
  Synthetic Construct
ccccgccaccgccuugg

SEQ ID NO: 678 - RNA, 22 nt, Artificial Sequence
  Synthetic Construct
caguugggucuaggggucagga

SEQ ID NO: 679 - RNA, 19 nt, Artificial Sequence
  Synthetic Construct
cuuggggcauggaguccca

SEQ ID NO: 680 - RNA, 16 nt, Artificial Sequence
  Synthetic Construct
aggaaacagggaccca

SEQ ID NO: 681 - RNA, 17 nt, Artificial Sequence
  Synthetic Construct
gacauucagacuaccug

SEQ ID NO: 682 - RNA, 18 nt, Artificial Sequence
  Synthetic Construct
auucuaagugccuuggcc

SEQ ID NO: 683 - RNA, 17 nt, Artificial Sequence
  Synthetic Construct
acucagucauggucauu

SEQ ID NO: 684 - RNA, 19 nt, Artificial Sequence
  Synthetic Construct
cugugggcucagcucuggg

SEQ ID NO: 685 - RNA, 16 nt, Artificial Sequence
  Synthetic Construct
cuaggaggccuuggcc

SEQ ID NO: 686 - RNA, 16 nt, Artificial Sequence
  Synthetic Construct
uccagcucgguggcac

SEQ ID NO: 687 - RNA, 21 nt, Artificial Sequence
  Synthetic Construct
ggcuccuccucucaggaugug

SEQ ID NO: 688 - RNA, 21 nt, Artificial Sequence
  Synthetic Construct
gcaggcacagacagcccuggc

SEQ ID NO: 689 - RNA, 20 nt, Artificial Sequence
  Synthetic Construct
ucagggagucaggggagggc

SEQ ID NO: 690 - RNA, 19 nt, Artificial Sequence
  Synthetic Construct
gggggaagaaaaggugggg

SEQ ID NO: 691 - RNA, 18 nt, Artificial Sequence
  Synthetic Construct
cauucaacuagugauugu

SEQ ID NO: 692 - RNA, 18 nt, Artificial Sequence
  Synthetic Construct
guguucucugauggacag

SEQ ID NO: 693 - RNA, 18 nt, Artificial Sequence
  Synthetic Construct
cagcagucccucccccug

SEQ ID NO: 694 - RNA, 17 nt, Artificial Sequence
  Synthetic Construct
ccaauuaccacuucuuu

SEQ ID NO: 695 - RNA, 17 nt, Artificial Sequence
  Synthetic Construct
cucagugacucaugugc

SEQ ID NO: 696 - RNA, 21 nt, Artificial Sequence
  Synthetic Construct
gcaguucugagcacaguacac

SEQ ID NO: 697 - RNA, 18 nt, Artificial Sequence
  Synthetic Construct
cuaggggguuugcccuug

SEQ ID NO: 698 - RNA, 16 nt, Artificial Sequence
  Synthetic Construct
cucuccucccggcuuc

SEQ ID NO: 699 - RNA, 21 nt, Artificial Sequence
  Synthetic Construct
gaguguaguucugagcagagc

SEQ ID NO: 700 - RNA, 18 nt, Artificial Sequence
  Synthetic Construct
gggucccggggagggggg

SEQ ID NO: 701 - RNA, 18 nt, Artificial Sequence
  Synthetic Construct
uaaaauuugcauccagga

SEQ ID NO: 702 - RNA, 17 nt, Artificial Sequence
  Synthetic Construct
uggggcucagcgaguuu

SEQ ID NO: 703 - RNA, 18 nt, Artificial Sequence
  Synthetic Construct
gggcucacaucaccccau

SEQ ID NO: 704 - RNA, 18 nt, Artificial Sequence
  Synthetic Construct
gcggcgaguccgacucau

SEQ ID NO: 705 - RNA, 17 nt, Artificial Sequence
  Synthetic Construct
accccacuccugguacc

SEQ ID NO: 706 - RNA, 19 nt, Artificial Sequence
  Synthetic Construct
ucucccuugagggcacuuu

SEQ ID NO: 707 - RNA, 17 nt, Artificial Sequence
  Synthetic Construct
uugucugcugaguuucc

SEQ ID NO: 708 - RNA, 19 nt, Artificial Sequence
  Synthetic Construct
gcauugugcagggcuauca

SEQ ID NO: 709 - RNA, 22 nt, Artificial Sequence
  Synthetic Construct
uaauacugucugguaaaaccgu

SEQ ID NO: 710 - RNA, 19 nt, Artificial Sequence
  Synthetic Construct
ugcccuccuuucuucccuc

SEQ ID NO: 711 - RNA, 16 nt, Artificial Sequence
  Synthetic Construct
uucagcaggaacagcu

SEQ ID NO: 712 - RNA, 18 nt, Artificial Sequence
  Synthetic Construct
ccccugggccggccuugg

SEQ ID NO: 713 - RNA, 17 nt, Artificial Sequence
  Synthetic Construct
cagccugacaggaacag

SEQ ID NO: 714 - RNA, 17 nt, Artificial Sequence
  Synthetic Construct
gggagucuacagcaggg

SEQ ID NO: 715 - RNA, 18 nt, Artificial Sequence
  Synthetic Construct
cagugcaauguuuuccuu

SEQ ID NO: 716 - RNA, 17 nt, Artificial Sequence
  Synthetic Construct
augugggcucaggcuca

SEQ ID NO: 717 - RNA, 16 nt, Artificial Sequence
  Synthetic Construct
ugccuuccugucugug

SEQ ID NO: 718 - RNA, 22 nt, Artificial Sequence
  Synthetic Construct
cugggacaggaggaggaggcag

SEQ ID NO: 719 - RNA, 18 nt, Artificial Sequence
  Synthetic Construct
gcuggugacaugagaggc

SEQ ID NO: 720 - RNA, 18 nt, Artificial Sequence
  Synthetic Construct
ugggagcuggacuacuuc

SEQ ID NO: 721 - RNA, 20 nt, Artificial Sequence
  Synthetic Construct
ucccacuacuucacuuguga

SEQ ID NO: 722 - RNA, 18 nt, Artificial Sequence
  Synthetic Construct
ccaguguggcucagcgag

SEQ ID NO: 723 - RNA, 17 nt, Artificial Sequence
  Synthetic Construct
uucugagcugaggacag

SEQ ID NO: 724 - RNA, 17 nt, Artificial Sequence
  Synthetic Construct
ccggcauguccagggca

SEQ ID NO: 725 - RNA, 18 nt, Artificial Sequence
  Synthetic Construct
ccuagacaccuccaguuc

SEQ ID NO: 726 - RNA, 17 nt, Artificial Sequence
  Synthetic Construct
uggagagaaaggcagua

SEQ ID NO: 727 - RNA, 19 nt, Artificial Sequence
  Synthetic Construct
aauguuuuuuccuguuucc

SEQ ID NO: 728 - RNA, 18 nt, Artificial Sequence
  Synthetic Construct
ucccuggaguuucuucuu

SEQ ID NO: 729 - RNA, 18 nt, Artificial Sequence
  Synthetic Construct
cuggagucuaggauucca

SEQ ID NO: 730 - RNA, 21 nt, Artificial Sequence
  Synthetic Construct
ugucuugcaggccgucaugca

SEQ ID NO: 731 - RNA, 16 nt, Artificial Sequence
  Synthetic Construct
gcagcauucauguccc

SEQ ID NO: 732 - RNA, 18 nt, Artificial Sequence
  Synthetic Construct
gaaagagagcugagugug

SEQ ID NO: 733 - RNA, 19 nt, Artificial Sequence
  Synthetic Construct
ggccuuguuccugucccca

SEQ ID NO: 734 - RNA, 20 nt, Artificial Sequence
  Synthetic Construct
agcccccuggccccaaaccc

SEQ ID NO: 735 - RNA, 18 nt, Artificial Sequence
  Synthetic Construct
cucugggaaaugggacag

SEQ ID NO: 736 - RNA, 18 nt, Artificial Sequence
  Synthetic Construct
ccgcuuucugagcuggac

SEQ ID NO: 737 - RNA, 17 nt, Artificial Sequence
  Synthetic Construct
ggugaggcuagcuggug

SEQ ID NO: 738 - RNA, 17 nt, Artificial Sequence
  Synthetic Construct
acauugccagggaguuu

SEQ ID NO: 739 - RNA, 17 nt, Artificial Sequence
  Synthetic Construct
cacuguggguacaugcu

SEQ ID NO: 740 - RNA, 17 nt, Artificial Sequence
  Synthetic Construct
ucccugagcaaagccac

SEQ ID NO: 741 - RNA, 23 nt, Artificial Sequence
  Synthetic Construct
ucuuggaguaggucauugggugg

SEQ ID NO: 742 - RNA, 18 nt, Artificial Sequence
  Synthetic Construct
gggauucuguagcuuccu

SEQ ID NO: 743 - RNA, 21 nt, Artificial Sequence
  Synthetic Construct
uuagcgguggaccgcccugcg

SEQ ID NO: 744 - RNA, 21 nt, Artificial Sequence
  Synthetic Construct
cugugggcucagcgcgugggg

SEQ ID NO: 745 - RNA, 18 nt, Artificial Sequence
  Synthetic Construct
cagccccacagccucaga

SEQ ID NO: 746 - RNA, 20 nt, Artificial Sequence
  Synthetic Construct
cccugagacccuaaccuuaa

SEQ ID NO: 747 - RNA, 18 nt, Artificial Sequence
  Synthetic Construct
uugcacuugucucaguga

SEQ ID NO: 748 - RNA, 20 nt, Artificial Sequence
  Synthetic Construct
uguuccucugucucccagac

SEQ ID NO: 749 - RNA, 19 nt, Artificial Sequence
  Synthetic Construct
ggcuugcaugggggacugg

SEQ ID NO: 750 - RNA, 17 nt, Artificial Sequence
  Synthetic Construct
ccaguuuucccaggauu

SEQ ID NO: 751 - RNA, 19 nt, Artificial Sequence
  Synthetic Construct
ccugagacccuaguuccac

SEQ ID NO: 752 - RNA, 22 nt, Artificial Sequence
  Synthetic Construct
uacggugagccugucauuauuc

SEQ ID NO: 753 - RNA, 19 nt, Artificial Sequence
  Synthetic Construct
ccucagaucagagccuugc

SEQ ID NO: 754 - RNA, 18 nt, Artificial Sequence
  Synthetic Construct
ggugggcuucccggaggg

SEQ ID NO: 755 - RNA, 18 nt, Artificial Sequence
  Synthetic Construct
cacugcaggacucagcag

SEQ ID NO: 756 - RNA, 17 nt, Artificial Sequence
  Synthetic Construct
ugagggaggagacugca

SEQ ID NO: 757 - RNA, 18 nt, Artificial Sequence
  Synthetic Construct
gaggcugaaggaagaugg

SEQ ID NO: 758 - RNA, 22 nt, Artificial Sequence
  Synthetic Construct
gucacugaugucuguagcugag

SEQ ID NO: 759 - RNA, 22 nt, Artificial Sequence
  Synthetic Construct
accugucuguggaaaggagcua

SEQ ID NO: 760 - RNA, 21 nt, Artificial Sequence
  Synthetic Construct
aaaagcaucaggaaguaccca

SEQ ID NO: 761 - RNA, 22 nt, Artificial Sequence
  Synthetic Construct
aguugccuuuuuguucccaugc

SEQ ID NO: 762 - RNA, 22 nt, Artificial Sequence
  Synthetic Construct
agaguuaacucaaaauggacua

SEQ ID NO: 763 - RNA, 22 nt, Artificial Sequence
  Synthetic Construct
uguugggauucagcaggaccau

SEQ ID NO: 764 - RNA, 17 nt, Artificial Sequence
  Synthetic Construct
gaagauggacguacuuu

SEQ ID NO: 765 - RNA, 21 nt, Artificial Sequence
  Synthetic Construct
ucugaauagagucugaagagu

SEQ ID NO: 766 - RNA, 22 nt, Artificial Sequence
  Synthetic Construct
caaggagacgggaacauggagc

SEQ ID NO: 767 - RNA, 20 nt, Artificial Sequence
  Synthetic Construct
aaaagcugggcugagaggcg

SEQ ID NO: 768 - RNA, 18 nt, Artificial Sequence
  Synthetic Construct
aggcuggagugagcggag

SEQ ID NO: 769 - RNA, 22 nt, Artificial Sequence
  Synthetic Construct
gcgacucugaaaacuagaaggu

SEQ ID NO: 770 - RNA, 20 nt, Artificial Sequence
  Synthetic Construct
aaagacucugcaagaugccu

SEQ ID NO: 771 - RNA, 21 nt, Artificial Sequence
  Synthetic Construct
acaggagugggggugggacau

SEQ ID NO: 772 - RNA, 21 nt, Artificial Sequence
  Synthetic Construct
caggaguggggggugggacgu

SEQ ID NO: 773 - RNA, 18 nt, Artificial Sequence
  Synthetic Construct
aggagaaguaaaguagaa

SEQ ID NO: 774 - RNA, 22 nt, Artificial Sequence
  Synthetic Construct
auggccagagcucacacagagg

SEQ ID NO: 775 - RNA, 21 nt, Artificial Sequence
  Synthetic Construct
gcaggacaggcagaaguggau

SEQ ID NO: 776 - RNA, 22 nt, Artificial Sequence
  Synthetic Construct
guccacuucugccugcccugcc

SEQ ID NO: 777 - RNA, 21 nt, Artificial Sequence
  Synthetic Construct
ugggcucaggguacaaagguu

SEQ ID NO: 778 - RNA, 21 nt, Artificial Sequence
  Synthetic Construct
cacaggcuuagaaaagacagu

SEQ ID NO: 779 - RNA, 22 nt, Artificial Sequence
  Synthetic Construct
gugacugauaccuuggaggcau

SEQ ID NO: 780 - RNA, 22 nt, Artificial Sequence
  Synthetic Construct
ugucguggggcuugcuggcuug

SEQ ID NO: 781 - RNA, 17 nt, Artificial Sequence
  Synthetic Construct
acagggaggagauugua

SEQ ID NO: 782 - RNA, 17 nt, Artificial Sequence
  Synthetic Construct
gccggacaagagggagg

SEQ ID NO: 783 - RNA, 17 nt, Artificial Sequence
  Synthetic Construct
uuggaggcguggguuuu

SEQ ID NO: 784 - RNA, 18 nt, Artificial Sequence
  Synthetic Construct
cucgaguuggaagaggcg

SEQ ID NO: 785 - RNA, 22 nt, Artificial Sequence
  Synthetic Construct
agauuguuucuuuugccgugca

SEQ ID NO: 786 - RNA, 22 nt, Artificial Sequence
  Synthetic Construct
auuucccugccauucccuuggc

SEQ ID NO: 787 - RNA, 17 nt, Artificial Sequence
  Synthetic Construct
ggugggggcuguuguuu

SEQ ID NO: 788 - RNA, 20 nt, Artificial Sequence
  Synthetic Construct
ggcuccuuggucuaggggua

SEQ ID NO: 789 - RNA, 22 nt, Artificial Sequence
  Synthetic Construct
cgucccggggcugcgcgaggca

SEQ ID NO: 790 - RNA, 22 nt, Artificial Sequence
  Synthetic Construct
uggggauuuggagaagugguga

SEQ ID NO: 791 - RNA, 17 nt, Artificial Sequence
  Synthetic Construct
ugguagagcugaggaca

SEQ ID NO: 792 - RNA, 23 nt, Artificial Sequence
  Synthetic Construct
uugaauucuuggccuuaagugau

SEQ ID NO: 793 - RNA, 20 nt, Artificial Sequence
  Synthetic Construct
gagcuuggucuguagcgguu

SEQ ID NO: 794 - RNA, 20 nt, Artificial Sequence
  Synthetic Construct
ggauccgagucacggcacca

SEQ ID NO: 795 - RNA, 17 nt, Artificial Sequence
  Synthetic Construct
aggguguguguguuuuu

SEQ ID NO: 796 - RNA, 17 nt, Artificial Sequence
  Synthetic Construct
ccugguggcuuccuuuu

SEQ ID NO: 797 - RNA, 22 nt, Artificial Sequence
  Synthetic Construct
ucacaagguauugacuggcgua

SEQ ID NO: 798 - RNA, 19 nt, Artificial Sequence
  Synthetic Construct
agagguagguguggaagaa

SEQ ID NO: 799 - RNA, 22 nt, Artificial Sequence
  Synthetic Construct
ccaggaggcggaggagguggag

SEQ ID NO: 800 - RNA, 22 nt, Artificial Sequence
  Synthetic Construct
auagugguugugaauuuaccuu

SEQ ID NO: 801 - RNA, 23 nt, Artificial Sequence
  Synthetic Construct
gauugagacuaguagggcuaggc

SEQ ID NO: 802 - RNA, 23 nt, Artificial Sequence
  Synthetic Construct
ugacacggaggguggcuugggaa

SEQ ID NO: 803 - RNA, 17 nt, Artificial Sequence
  Synthetic Construct
gagacugggguggggcc

SEQ ID NO: 804 - RNA, 21 nt, Artificial Sequence
  Synthetic Construct
aagguuuggauagaugcaaua

SEQ ID NO: 805 - RNA, 22 nt, Artificial Sequence
  Synthetic Construct
cucaaguagucugaccagggga

SEQ ID NO: 806 - RNA, 18 nt, Artificial Sequence
  Synthetic Construct
gggugcgggccggcgggg

SEQ ID NO: 807 - RNA, 22 nt, Artificial Sequence
  Synthetic Construct
uggcggcgguaguuaugggcuu

SEQ ID NO: 808 - RNA, 18 nt, Artificial Sequence
  Synthetic Construct
agagcagaaggaugagau

SEQ ID NO: 809 - RNA, 22 nt, Artificial Sequence
  Synthetic Construct
gcucccucuagggucgcucgga

SEQ ID NO: 810 - RNA, 21 nt, Artificial Sequence
  Synthetic Construct
uggcaaacguggaagccgaga

SEQ ID NO: 811 - RNA, 22 nt, Artificial Sequence
  Synthetic Construct
ugggaacuuaguagagguuuaa

SEQ ID NO: 812 - RNA, 18 nt, Artificial Sequence
  Synthetic Construct
ggugggggguguuguuuu

SEQ ID NO: 813 - RNA, 22 nt, Artificial Sequence
  Synthetic Construct
cuagugcucuccguuacaagua

SEQ ID NO: 814 - RNA, 22 nt, Artificial Sequence
  Synthetic Construct
uuguggcuggucaugaggcuaa

SEQ ID NO: 815 - RNA, 22 nt, Artificial Sequence
  Synthetic Construct
caagggaccaagcauucauuau

SEQ ID NO: 816 - RNA, 22 nt, Artificial Sequence
  Synthetic Construct
caggaaggauuuagggacaggc

SEQ ID NO: 817 - RNA, 22 nt, Artificial Sequence
  Synthetic Construct
cuauuaaggacauuugugauuc

SEQ ID NO: 818 - RNA, 22 nt, Artificial Sequence
  Synthetic Construct
auuaaggacauuugugauugau

SEQ ID NO: 819 - RNA, 17 nt, Artificial Sequence
  Synthetic Construct
gaggcugagcugaggag

SEQ ID NO: 820 - RNA, 22 nt, Artificial Sequence
  Synthetic Construct
cgcgcggccgugcucggagcag

SEQ ID NO: 821 - RNA, 22 nt, Artificial Sequence
  Synthetic Construct
uugcauauguaggaugucccau

SEQ ID NO: 822 - RNA, 21 nt, Artificial Sequence
  Synthetic Construct
agccaaguggaaguuacuuua

SEQ ID NO: 823 - RNA, 17 nt, Artificial Sequence
  Synthetic Construct
ggagugggcuggugguu

SEQ ID NO: 824 - RNA, 22 nt, Artificial Sequence
  Synthetic Construct
uuucuauuucucaguggggcuc

SEQ ID NO: 825 - RNA, 17 nt, Artificial Sequence
  Synthetic Construct
gggguggucuguuguug

SEQ ID NO: 826 - RNA, 20 nt, Artificial Sequence
  Synthetic Construct
aaaaggcgggagaagcccca

SEQ ID NO: 827 - RNA, 20 nt, Artificial Sequence
  Synthetic Construct
uaacggccgcgguacccuaa

SEQ ID NO: 828 - RNA, 17 nt, Artificial Sequence
  Synthetic Construct
gcugggcgaggcuggca

SEQ ID NO: 829 - RNA, 19 nt, Artificial Sequence
  Synthetic Construct
agagcuggcugaagggcag

SEQ ID NO: 830 - RNA, 18 nt, Artificial Sequence
  Synthetic Construct
agggggcgggcuccggcg

SEQ ID NO: 831 - RNA, 21 nt, Artificial Sequence
  Synthetic Construct
uggggcuagugaugcaggacg

SEQ ID NO: 832 - RNA, 22 nt, Artificial Sequence
  Synthetic Construct
ucugguaagagauuugggcaua

SEQ ID NO: 833 - RNA, 22 nt, Artificial Sequence
  Synthetic Construct
aauguggacuggugugaccaaa

SEQ ID NO: 834 - RNA, 17 nt, Artificial Sequence
  Synthetic Construct
ggggcugggcgcgcgcc

SEQ ID NO: 835 - RNA, 21 nt, Artificial Sequence
  Synthetic Construct
agaaggccuuuccaucucugu

SEQ ID NO: 836 - RNA, 22 nt, Artificial Sequence
  Synthetic Construct
ccagacuguggcugaccagagg

SEQ ID NO: 837 - RNA, 21 nt, Artificial Sequence
  Synthetic Construct
aauguaaacaggcuuuuugcu

SEQ ID NO: 838 - RNA, 22 nt, Artificial Sequence
  Synthetic Construct
gaggaaacugaagcugagaggg

SEQ ID NO: 839 - RNA, 17 nt, Artificial Sequence
  Synthetic Construct
cuccgggacggcugggc

SEQ ID NO: 840 - RNA, 22 nt, Artificial Sequence
  Synthetic Construct
ugggcuggcagggcaagugcug

SEQ ID NO: 841 - RNA, 17 nt, Artificial Sequence
  Synthetic Construct
aagacugagaggaggga

SEQ ID NO: 842 - RNA, 22 nt, Artificial Sequence
  Synthetic Construct
uggcaguguauuguuagcuggu

SEQ ID NO: 843 - RNA, 22 nt, Artificial Sequence
  Synthetic Construct
cagccacaacuacccugccacu

SEQ ID NO: 844 - RNA, 25 nt, Artificial Sequence
  Synthetic Construct
uaggcaguguauugcuagcggcugu

SEQ ID NO: 845 - RNA, 17 nt, Artificial Sequence
  Synthetic Construct
ugagguaguaguuucuu

SEQ ID NO: 846 - RNA, 21 nt, Artificial Sequence
  Synthetic Construct
uaugugaccucggaugaauca

SEQ ID NO: 847 - RNA, 22 nt, Artificial Sequence
  Synthetic Construct
gcugaugaugauggugcugaag

SEQ ID NO: 848 - RNA, 22 nt, Artificial Sequence
  Synthetic Construct
uuuaagcaggaaauagaauuua

SEQ ID NO: 849 - RNA, 22 nt, Artificial Sequence
  Synthetic Construct
ugugacaauagagaugaacaug

SEQ ID NO: 850 - RNA, 18 nt, Artificial Sequence
  Synthetic Construct
aggcugggcugggacgga

SEQ ID NO: 851 - RNA, 20 nt, Artificial Sequence
  Synthetic Construct
aaauggguggucugaggcaa

SEQ ID NO: 852 - RNA, 20 nt, Artificial Sequence
  Synthetic Construct
cuggguugggcugggcuggg

SEQ ID NO: 853 - RNA, 17 nt, Artificial Sequence
  Synthetic Construct
gcggggcugggcgcgcg

SEQ ID NO: 854 - RNA, 22 nt, Artificial Sequence
  Synthetic Construct
acuaaaggauauagaagguuuu

SEQ ID NO: 855 - RNA, 22 nt, Artificial Sequence
  Synthetic Construct
uuuugcgauguguuccuaauau

SEQ ID NO: 856 - RNA, 22 nt, Artificial Sequence
  Synthetic Construct
uuuugcgauguguuccuaauau

SEQ ID NO: 857 - RNA, 22 nt, Artificial Sequence
  Synthetic Construct
uuuugcaauauguuccugaaua

SEQ ID NO: 858 - RNA, 22 nt, Artificial Sequence
  Synthetic Construct
ugagggaguaggauguaugguu

SEQ ID NO: 859 - RNA, 22 nt, Artificial Sequence
  Synthetic Construct
gaagaacuguugcauuugcccu

SEQ ID NO: 860 - RNA, 22 nt, Artificial Sequence
  Synthetic Construct
cagggccucacuguaucgccca

SEQ ID NO: 861 - RNA, 22 nt, Artificial Sequence
  Synthetic Construct
agacugacggcuggaggcccau

SEQ ID NO: 862 - RNA, 18 nt, Artificial Sequence
  Synthetic Construct
acaggcaggauuggggaa

SEQ ID NO: 863 - RNA, 22 nt, Artificial Sequence
  Synthetic Construct
aggacuggacucccggcagccc

SEQ ID NO: 864 - RNA, 17 nt, Artificial Sequence
  Synthetic Construct
gggagaagggucggggc

SEQ ID NO: 865 - RNA, 25 nt, Artificial Sequence
  Synthetic Construct
aaauaugaugaaacucacagcugag

SEQ ID NO: 866 - RNA, 26 nt, Artificial Sequence
  Synthetic Construct
gcucagggaugauaacugugcugaga

SEQ ID NO: 867 - RNA, 18 nt, Artificial Sequence
  Synthetic Construct
cagcagugcgcagggcug

SEQ ID NO: 868 - RNA, 22 nt, Artificial Sequence
  Synthetic Construct
aaaccguuaccauuacugaguu

SEQ ID NO: 869 - RNA, 22 nt, Artificial Sequence
  Synthetic Construct
uagcaagagaaccauuaccauu

SEQ ID NO: 870 - RNA, 22 nt, Artificial Sequence
  Synthetic Construct
aacuguuugcagaggaaacuga

SEQ ID NO: 871 - RNA, 20 nt, Artificial Sequence
  Synthetic Construct
ccugcguguuuucuguccaa

SEQ ID NO: 872 - RNA, 20 nt, Artificial Sequence
  Synthetic Construct
ccugcguguuuucuguccaa

SEQ ID NO: 873 - RNA, 22 nt, Artificial Sequence
  Synthetic Construct
gcuaaggaaguccugugcucag

SEQ ID NO: 874 - RNA, 21 nt, Artificial Sequence
  Synthetic Construct
ugacucugccuguaggccggu

SEQ ID NO: 875 - RNA, 21 nt, Artificial Sequence
  Synthetic Construct
gaccgagagggccucggcugu

SEQ ID NO: 876 - RNA, 22 nt, Artificial Sequence
  Synthetic Construct
auagcagcaugaaccugucuca

SEQ ID NO: 877 - RNA, 21 nt, Artificial Sequence
  Synthetic Construct
auagcagcauaagccugucuc

SEQ ID NO: 878 - RNA, 21 nt, Artificial Sequence
  Synthetic Construct
ggggggaugugcaugcugguu

SEQ ID NO: 879 - RNA, 22 nt, Artificial Sequence
  Synthetic Construct
gcugacagcagggcuggccgcu

SEQ ID NO: 880 - RNA, 22 nt, Artificial Sequence
  Synthetic Construct
uggucugcaaagagaugacugu

SEQ ID NO: 881 - RNA, 22 nt, Artificial Sequence
  Synthetic Construct
ucauuauauguaugaucuggac

SEQ ID NO: 882 - RNA, 22 nt, Artificial Sequence
  Synthetic Construct
aggccaucagcaguccaaugaa

SEQ ID NO: 883 - RNA, 18 nt, Artificial Sequence
  Synthetic Construct
cccagcaggacgggagcg

SEQ ID NO: 884 - RNA, 17 nt, Artificial Sequence
  Synthetic Construct
auggagaaggcuucuga

SEQ ID NO: 885 - RNA, 17 nt, Artificial Sequence
  Synthetic Construct
ccccggggagcccggcg

SEQ ID NO: 886 - RNA, 22 nt, Artificial Sequence
  Synthetic Construct
uggaaggagguugccggacgcu

SEQ ID NO: 887 - RNA, 17 nt, Artificial Sequence
  Synthetic Construct
ggauggaggaggggucu

SEQ ID NO: 888 - RNA, 17 nt, Artificial Sequence
  Synthetic Construct
guggaccuggcugggac

SEQ ID NO: 889 - RNA, 21 nt, Artificial Sequence
  Synthetic Construct
ucgugcauauaucuaccacau

SEQ ID NO: 890 - RNA, 22 nt, Artificial Sequence
  Synthetic Construct
ugagccgagcugagcuuagcug

SEQ ID NO: 891 - RNA, 22 nt, Artificial Sequence
  Synthetic Construct
gagcuuggaugagcugggcuga

SEQ ID NO: 892 - RNA, 22 nt, Artificial Sequence
  Synthetic Construct
gcugaacugggcugagcugggc

SEQ ID NO: 893 - RNA, 22 nt, Artificial Sequence
  Synthetic Construct
acccuaucaauauugucucugc

SEQ ID NO: 894 - RNA, 21 nt, Artificial Sequence
  Synthetic Construct
uuaguccugccuguagguuua

SEQ ID NO: 895 - RNA, 21 nt, Artificial Sequence
  Synthetic Construct
gcaguccaugggcauauacac

SEQ ID NO: 896 - RNA, 22 nt, Artificial Sequence
  Synthetic Construct
ugccgcccucucgcugcucuag

SEQ ID NO: 897 - RNA, 20 nt, Artificial Sequence
  Synthetic Construct
auaugccuggcuagcuccuc

SEQ ID NO: 898 - RNA, 19 nt, Artificial Sequence
  Synthetic Construct
cggcgcgaccggcccgggg

SEQ ID NO: 899 - RNA, 21 nt, Artificial Sequence
  Synthetic Construct
ucuugaagucagaacccgcaa

SEQ ID NO: 900 - RNA, 22 nt, Artificial Sequence
  Synthetic Construct
aacucguguucaaagccuuuag

SEQ ID NO: 901 - RNA, 22 nt, Artificial Sequence
  Synthetic Construct
uacuaacugcagauucaaguga

SEQ ID NO: 902 - RNA, 23 nt, Artificial Sequence
  Synthetic Construct
ccuggacaccgcucagccggccg

SEQ ID NO: 903 - RNA, 20 nt, Artificial Sequence
  Synthetic Construct
ucacucucaccuugcuuugc

SEQ ID NO: 904 - RNA, 23 nt, Artificial Sequence
  Synthetic Construct
ugggccagggagcagcugguggg

SEQ ID NO: 905 - RNA, 24 nt, Artificial Sequence
  Synthetic Construct
ugcccaugccauacuuuugccuca

SEQ ID NO: 906 - RNA, 22 nt, Artificial Sequence
  Synthetic Construct
auggcaucguccccugguggcu

SEQ ID NO: 907 - RNA, 22 nt, Artificial Sequence
  Synthetic Construct
gacacaugaccauaaaugcuaa

SEQ ID NO: 908 - RNA, 23 nt, Artificial Sequence
  Synthetic Construct
uggagagagaaaagagacagaag

SEQ ID NO: 909 - RNA, 19 nt, Artificial Sequence
  Synthetic Construct
accaggcaagaaauauugu

SEQ ID NO: 910 - RNA, 21 nt, Artificial Sequence
  Synthetic Construct
auugucccucucccuucccag

SEQ ID NO: 911 - RNA, 23 nt, Artificial Sequence
  Synthetic Construct
gaagauggugcugugcugaggaa

SEQ ID NO: 912 - RNA, 20 nt, Artificial Sequence
  Synthetic Construct
ugugggacugcaaaugggag

SEQ ID NO: 913 - RNA, 24 nt, Artificial Sequence
  Synthetic Construct
ugggcgaggggugggcucucagag

SEQ ID NO: 914 - RNA, 21 nt, Artificial Sequence
  Synthetic Construct
agguagaaugaggccugacau

SEQ ID NO: 915 - RNA, 20 nt, Artificial Sequence
  Synthetic Construct
cggggugggugaggucgggc

SEQ ID NO: 916 - RNA, 22 nt, Artificial Sequence
  Synthetic Construct
aggggacugguuaauagaacua

SEQ ID NO: 917 - RNA, 22 nt, Artificial Sequence
  Synthetic Construct
ucucugagcaaggcuuaacacc

SEQ ID NO: 918 - RNA, 22 nt, Artificial Sequence
  Synthetic Construct
ugugggaucuggaggcaucugg

SEQ ID NO: 919 - RNA, 21 nt, Artificial Sequence
  Synthetic Construct
acccucgucagguccccgggg

SEQ ID NO: 920 - RNA, 23 nt, Artificial Sequence
  Synthetic Construct
ugggcugagggcaggaggccugu

SEQ ID NO: 921 - RNA, 23 nt, Artificial Sequence
  Synthetic Construct
aauguggaaguggucugaggcau

SEQ ID NO: 922 - RNA, 23 nt, Artificial Sequence
  Synthetic Construct
gugaguguggauccuggaggaau

SEQ ID NO: 923 - RNA, 22 nt, Artificial Sequence
  Synthetic Construct
uuucuucuuagacauggcaacg

SEQ ID NO: 924 - RNA, 22 nt, Artificial Sequence
  Synthetic Construct
uuucuucuuagacauggcagcu

SEQ ID NO: 925 - RNA, 23 nt, Artificial Sequence
  Synthetic Construct
auacacauacacgcaacacacau

SEQ ID NO: 926 - RNA, 23 nt, Artificial Sequence
  Synthetic Construct
ugcagcucugguggaaaauggag

SEQ ID NO: 927 - RNA, 22 nt, Artificial Sequence
  Synthetic Construct
aacuagcucuguggauccugac

SEQ ID NO: 928 - RNA, 22 nt, Artificial Sequence
  Synthetic Construct
uuagccaauuguccaucuuuag

SEQ ID NO: 929 - RNA, 22 nt, Artificial Sequence
  Synthetic Construct
aaagauggacaauuggcuaaau

SEQ ID NO: 930 - RNA, 24 nt, Artificial Sequence
  Synthetic Construct
agcugagcuccauggacgugcagu

SEQ ID NO: 931 - RNA, 22 nt, Artificial Sequence
  Synthetic Construct
cuuccggucugugagccccguc

SEQ ID NO: 932 - RNA, 26 nt, Artificial Sequence
  Synthetic Construct
cucggccgcggcgcguagcccccgcc

SEQ ID NO: 933 - RNA, 21 nt, Artificial Sequence
  Synthetic Construct
auacaugucagauuguaugcc

SEQ ID NO: 934 - RNA, 23 nt, Artificial Sequence
  Synthetic Construct
uugcaugucagauuguaauuccc

SEQ ID NO: 935 - RNA, 22 nt, Artificial Sequence
  Synthetic Construct
acuggggagcagaaggagaacc

SEQ ID NO: 936 - RNA, 23 nt, Artificial Sequence
  Synthetic Construct
agggaaaaaaaaaaggauuuguc

SEQ ID NO: 937 - RNA, 22 nt, Artificial Sequence
  Synthetic Construct
uguguccgggaaguggaggagg

SEQ ID NO: 938 - RNA, 22 nt, Artificial Sequence
  Synthetic Construct
aagcgaccaugauguaacuuca

SEQ ID NO: 939 - RNA, 22 nt, Artificial Sequence
  Synthetic Construct
accgaagacugugcgcuaaucu

SEQ ID NO: 940 - RNA, 21 nt, Artificial Sequence
  Synthetic Construct
uuacacagcuggacagaggca

SEQ ID NO: 941 - RNA, 22 nt, Artificial Sequence
  Synthetic Construct
uccaggcaggagccggacugga

SEQ ID NO: 942 - RNA, 21 nt, Artificial Sequence
  Synthetic Construct
cugggcucgggacgcgcggcu

SEQ ID NO: 943 - RNA, 22 nt, Artificial Sequence
  Synthetic Construct
ggggcugugauugaccagcagg

SEQ ID NO: 944 - RNA, 21 nt, Artificial Sequence
  Synthetic Construct
gagccaguggugagacaguga

SEQ ID NO: 945 - RNA, 22 nt, Artificial Sequence
  Synthetic Construct
uuguucuuuggucuuucagcca

SEQ ID NO: 946 - RNA, 22 nt, Artificial Sequence
  Synthetic Construct
aagguauuguucagacuuauga

SEQ ID NO: 947 - RNA, 22 nt, Artificial Sequence
  Synthetic Construct
ucugugauagagauucuuugcu

SEQ ID NO: 948 - RNA, 21 nt, Artificial Sequence
  Synthetic Construct
ucugaauuguaagaguuguua

SEQ ID NO: 949 - RNA, 22 nt, Artificial Sequence
  Synthetic Construct
aacgggaaugcaggcuguaucu

SEQ ID NO: 950 - RNA, 23 nt, Artificial Sequence
  Synthetic Construct
ucugaguuccuggagccuggucu

SEQ ID NO: 951 - RNA, 23 nt, Artificial Sequence
  Synthetic Construct
uggagauccagugcucgcccgau

SEQ ID NO: 952 - RNA, 22 nt, Artificial Sequence
  Synthetic Construct
cucucuacugacuugcaacaua

SEQ ID NO: 953 - RNA, 26 nt, Artificial Sequence
  Synthetic Construct
cccagggcuuggaguggggcaagguu

SEQ ID NO: 954 - RNA, 23 nt, Artificial Sequence
  Synthetic Construct
uaucugcugggcuuucugguguu

SEQ ID NO: 955 - RNA, 21 nt, Artificial Sequence
  Synthetic Construct
uggcuguuggagggggcaggc

SEQ ID NO: 956 - RNA, 22 nt, Artificial Sequence
  Synthetic Construct
uaggggcagcagaggaccuggg

SEQ ID NO: 957 - RNA, 22 nt, Artificial Sequence
  Synthetic Construct
uugaggagacauggugggggcc

SEQ ID NO: 958 - RNA, 21 nt, Artificial Sequence
  Synthetic Construct
gcagcccagcugaggccucug

SEQ ID NO: 959 - RNA, 23 nt, Artificial Sequence
  Synthetic Construct
guccuccaggccaugagcugcgg

SEQ ID NO: 960 - RNA, 22 nt, Artificial Sequence
  Synthetic Construct
ucaggcaguguggguaucagau

SEQ ID NO: 961 - RNA, 23 nt, Artificial Sequence
  Synthetic Construct
auacugugaauuucacugucaca

SEQ ID NO: 962 - RNA, 22 nt, Artificial Sequence
  Synthetic Construct
agguguuauccuauccauuugc

SEQ ID NO: 963 - RNA, 22 nt, Artificial Sequence
  Synthetic Construct
caggaggcagugggcgagcagg

SEQ ID NO: 964 - RNA, 22 nt, Artificial Sequence
  Synthetic Construct
ugcaagacggauacugucaucu

SEQ ID NO: 965 - RNA, 22 nt, Artificial Sequence
  Synthetic Construct
agggggcgcagucacugacgug

SEQ ID NO: 966 - RNA, 23 nt, Artificial Sequence
  Synthetic Construct
ucaaaauguagaggaagacccca

SEQ ID NO: 967 - RNA, 22 nt, Artificial Sequence
  Synthetic Construct
aauuuacucugcaaucuucucc

SEQ ID NO: 968 - RNA, 26 nt, Artificial Sequence
  Synthetic Construct
cacaggacugacuccucaccccagug

SEQ ID NO: 969 - RNA, 22 nt, Artificial Sequence
  Synthetic Construct
uuggccaccacaccuaccccuu

SEQ ID NO: 970 - RNA, 22 nt, Artificial Sequence
  Synthetic Construct
uguaguuguauuguauugccac

SEQ ID NO: 971 - RNA, 22 nt, Artificial Sequence
  Synthetic Construct
ucagucacauaucuagugucua

SEQ ID NO: 972 - RNA, 22 nt, Artificial Sequence
  Synthetic Construct
ucaaucacuugguaauugcugu

SEQ ID NO: 973 - RNA, 25 nt, Artificial Sequence
  Synthetic Construct
agcggggaggaagugggcgcugcuu

SEQ ID NO: 974 - RNA, 22 nt, Artificial Sequence
  Synthetic Construct
agcccgccccagccgagguucu

SEQ ID NO: 975 - RNA, 21 nt, Artificial Sequence
  Synthetic Construct
agagaugccgccuugcuccuu

SEQ ID NO: 976 - RNA, 22 nt, Artificial Sequence
  Synthetic Construct
acaacagugacuugcucuccaa

SEQ ID NO: 977 - RNA, 18 nt, Artificial Sequence
  Synthetic Construct
gggugagggcaggugguu

SEQ ID NO: 978 - RNA, 18 nt, Artificial Sequence
  Synthetic Construct
cgugucuucuggcuugau

SEQ ID NO: 979 - RNA, 21 nt, Artificial Sequence
  Synthetic Construct
aaugagagaccuguacuguau

SEQ ID NO: 980 - RNA, 22 nt, Artificial Sequence
  Synthetic Construct
uucucccacuaccaggcuccca

SEQ ID NO: 981 - RNA, 22 nt, Artificial Sequence
  Synthetic Construct
aacucugaccccuuagguugau

SEQ ID NO: 982 - RNA, 23 nt, Artificial Sequence
  Synthetic Construct
gugccaccuuaacugcagccaau

SEQ ID NO: 983 - RNA, 22 nt, Artificial Sequence
  Synthetic Construct
aagggggaaggaaacauggaga

SEQ ID NO: 984 - RNA, 21 nt, Artificial Sequence
  Synthetic Construct
acacauggguggcuguggccu

SEQ ID NO: 985 - RNA, 21 nt, Artificial Sequence
  Synthetic Construct
agcuguaccugaaaccaagca

SEQ ID NO: 986 - RNA, 22 nt, Artificial Sequence
  Synthetic Construct
ucacaaaucuauaauaugcagg

SEQ ID NO: 987 - RNA, 21 nt, Artificial Sequence
  Synthetic Construct
ugcuuaaguuguaccaaguau

SEQ ID NO: 988 - RNA, 22 nt, Artificial Sequence
  Synthetic Construct
ugagggcuccaggugacggugg

SEQ ID NO: 989 - RNA, 23 nt, Artificial Sequence
  Synthetic Construct
ggcaggagggcugugccagguug

SEQ ID NO: 990 - RNA, 24 nt, Artificial Sequence
  Synthetic Construct
ugggggagccaugagauaagagca

SEQ ID NO: 991 - RNA, 23 nt, Artificial Sequence
  Synthetic Construct
aacugaaccaggagugagcuucg

SEQ ID NO: 992 - RNA, 21 nt, Artificial Sequence
  Synthetic Construct
agacccugcagccuucccacc

SEQ ID NO: 993 - RNA, 22 nt, Artificial Sequence
  Synthetic Construct
acccagguucccucuggccgca

SEQ ID NO: 994 - RNA, 22 nt, Artificial Sequence
  Synthetic Construct
auagugggaagcuggcagauuc

SEQ ID NO: 995 - RNA, 25 nt, Artificial Sequence
  Synthetic Construct
caugcugaccucccuccugccccag

SEQ ID NO: 996 - RNA, 22 nt, Artificial Sequence
  Synthetic Construct
ucauuuaucuguugggaagcua

SEQ ID NO: 997 - RNA, 23 nt, Artificial Sequence
  Synthetic Construct
cuggcggagcccauuccaugcca

SEQ ID NO: 998 - RNA, 22 nt, Artificial Sequence
  Synthetic Construct
ugcugggggccacaugagugug

SEQ ID NO: 999 - RNA, 23 nt, Artificial Sequence
  Synthetic Construct
uguagagcagggagcaggaagcu

SEQ ID NO: 1000 - RNA, 22 nt, Artificial Sequence
  Synthetic Construct
aaucccaaugcuagacccggug

SEQ ID NO: 1001 - RNA, 22 nt, Artificial Sequence
  Synthetic Construct
gcugcgggcugcggucagggcg

SEQ ID NO: 1002 - RNA, 22 nt, Artificial Sequence
  Synthetic Construct
ccuaauuugaacaccuucggua

SEQ ID NO: 1003 - RNA, 19 nt, Artificial Sequence
  Synthetic Construct
aggcagguuaucugggcug

SEQ ID NO: 1004 - RNA, 20 nt, Artificial Sequence
  Synthetic Construct
augcgaggaugcugacagug

SEQ ID NO: 1005 - RNA, 22 nt, Artificial Sequence
  Synthetic Construct
ugaaacuggagcgccuggagga

SEQ ID NO: 1006 - RNA, 25 nt, Artificial Sequence
  Synthetic Construct
aagggaggaggagcggaggggcccu

SEQ ID NO: 1007 - RNA, 22 nt, Artificial Sequence
  Synthetic Construct
gcccgagaggauccgucccugc

SEQ ID NO: 1008 - RNA, 23 nt, Artificial Sequence
  Synthetic Construct
cgggcuguccggaggggucggcu

SEQ ID NO: 1009 - RNA, 23 nt, Artificial Sequence
  Synthetic Construct
ucaggcaaagggauauuuacaga

SEQ ID NO: 1010 - RNA, 21 nt, Artificial Sequence
  Synthetic Construct
uuucugucuuuucugguccag

SEQ ID NO: 1011 - RNA, 23 nt, Artificial Sequence
  Synthetic Construct
ucuaaagacuagacuucgcuaug

SEQ ID NO: 1012 - RNA, 23 nt, Artificial Sequence
  Synthetic Construct
ugaguggggcucccgggacggcg

SEQ ID NO: 1013 - RNA, 21 nt, Artificial Sequence
  Synthetic Construct
agcggugcuccugcgggccga

SEQ ID NO: 1014 - RNA, 22 nt, Artificial Sequence
  Synthetic Construct
aaggcccgggcuuuccucccag

SEQ ID NO: 1015 - RNA, 21 nt, Artificial Sequence
  Synthetic Construct
gagguuuggggaggauuugcu

SEQ ID NO: 1016 - RNA, 22 nt, Artificial Sequence
  Synthetic Construct
ugcggggacaggccagggcauc

SEQ ID NO: 1017 - RNA, 22 nt, Artificial Sequence
  Synthetic Construct
ccugacccacccccucccgcag

SEQ ID NO: 1018 - RNA, 24 nt, Artificial Sequence
  Synthetic Construct
agaggacccguagcugcuagaagg

SEQ ID NO: 1019 - RNA, 22 nt, Artificial Sequence
  Synthetic Construct
uuguggaucucaaggaugugcu

SEQ ID NO: 1020 - RNA, 22 nt, Artificial Sequence
  Synthetic Construct
caaggccaaaggaagagaacag

SEQ ID NO: 1021 - RNA, 23 nt, Artificial Sequence
  Synthetic Construct
augcggaccuggguuagcggagu

SEQ ID NO: 1022 - RNA, 22 nt, Artificial Sequence
  Synthetic Construct
uuucccuucagagccuggcuuu

SEQ ID NO: 1023 - RNA, 22 nt, Artificial Sequence
  Synthetic Construct
ccagagaugguugccuuccuau

SEQ ID NO: 1024 - RNA, 22 nt, Artificial Sequence
  Synthetic Construct
caugacgucacagaggcuucgc

SEQ ID NO: 1025 - RNA, 23 nt, Artificial Sequence
  Synthetic Construct
gugagugggagccgguggggcug

SEQ ID NO: 1026 - RNA, 21 nt, Artificial Sequence
  Synthetic Construct
uaggacuagauguuggaauua

SEQ ID NO: 1027 - RNA, 22 nt, Artificial Sequence
  Synthetic Construct
aaauucauguucaaucuaaacc

SEQ ID NO: 1028 - RNA, 21 nt, Artificial Sequence
  Synthetic Construct
acaaggugugcaugccugacc

SEQ ID NO: 1029 - RNA, 21 nt, Artificial Sequence
  Synthetic Construct
ccaaaucuugaucagaagccu

SEQ ID NO: 1030 - RNA, 24 nt, Artificial Sequence
  Synthetic Construct
aggcaggggcuggugcugggcggg

SEQ ID NO: 1031 - RNA, 22 nt, Artificial Sequence
  Synthetic Construct
uuaacuccuuucacacccaugg

SEQ ID NO: 1032 - RNA, 22 nt, Artificial Sequence
  Synthetic Construct
ugagugauugauagcuauguuc

SEQ ID NO: 1033 - RNA, 21 nt, Artificial Sequence
  Synthetic Construct
ucugaaagagcaguugguguu

SEQ ID NO: 1034 - RNA, 23 nt, Artificial Sequence
  Synthetic Construct
cgcgggcgcuccuggccgccgcc

SEQ ID NO: 1035 - RNA, 20 nt, Artificial Sequence
  Synthetic Construct
ccaggagauccagagagaau

SEQ ID NO: 1036 - RNA, 22 nt, Artificial Sequence
  Synthetic Construct
ucugccauccucccuccccuac

SEQ ID NO: 1037 - RNA, 18 nt, Artificial Sequence
  Synthetic Construct
ugagaugacacuguagcu

SEQ ID NO: 1038 - RNA, 21 nt, Artificial Sequence
  Synthetic Construct
agcagacuugaccuacaauua

SEQ ID NO: 1039 - RNA, 22 nt, Artificial Sequence
  Synthetic Construct
ccugcaacuuugccugaucaga

SEQ ID NO: 1040 - RNA, 22 nt, Artificial Sequence
  Synthetic Construct
cagaacaggagcauagaaaggc

SEQ ID NO: 1041 - RNA, 21 nt, Artificial Sequence
  Synthetic Construct
auugccuaacaugugccagaa

SEQ ID NO: 1042 - RNA, 22 nt, Artificial Sequence
  Synthetic Construct
uuaauuuuuuguuucggucacu

SEQ ID NO: 1043 - RNA, 22 nt, Artificial Sequence
  Synthetic Construct
guggaccaggauggcaagggcu

SEQ ID NO: 1044 - RNA, 22 nt, Artificial Sequence
  Synthetic Construct
uucuagaugagagauauauaua

SEQ ID NO: 1045 - RNA, 22 nt, Artificial Sequence
  Synthetic Construct
ucuucuuccuuugcagaguuga

SEQ ID NO: 1046 - RNA, 22 nt, Artificial Sequence
  Synthetic Construct
uaggagggaauaguaaaagcag

SEQ ID NO: 1047 - RNA, 22 nt, Artificial Sequence
  Synthetic Construct
acccuugagccugaucccuagc

SEQ ID NO: 1048 - RNA, 21 nt, Artificial Sequence
  Synthetic Construct
uagcggggauuccaauauugg

SEQ ID NO: 1049 - RNA, 22 nt, Artificial Sequence
  Synthetic Construct
ugauugucuucauaucuagaac

SEQ ID NO: 1050 - RNA, 23 nt, Artificial Sequence
  Synthetic Construct
ccccgguguuggggcgcgucugc

SEQ ID NO: 1051 - RNA, 20 nt, Artificial Sequence
  Synthetic Construct
ugaggagaugcugggacuga

SEQ ID NO: 1052 - RNA, 21 nt, Artificial Sequence
  Synthetic Construct
agagucggcgacgccgccagc

SEQ ID NO: 1053 - RNA, 22 nt, Artificial Sequence
  Synthetic Construct
ugaagccagcucuggucugggc

SEQ ID NO: 1054 - RNA, 24 nt, Artificial Sequence
  Synthetic Construct
gaugcgccgcccacugccccgcgc

SEQ ID NO: 1055 - RNA, 22 nt, Artificial Sequence
  Synthetic Construct
uuacggaccagcuaagggaggc

SEQ ID NO: 1056 - RNA, 22 nt, Artificial Sequence
  Synthetic Construct
guauacaccugauauguguaug

SEQ ID NO: 1057 - RNA, 20 nt, Artificial Sequence
  Synthetic Construct
aucgcuuuaccauucauguu

SEQ ID NO: 1058 - RNA, 18 nt, Artificial Sequence
  Synthetic Construct
uggauaugaugacugaaa

SEQ ID NO: 1059 - RNA, 18 nt, Artificial Sequence
  Synthetic Construct
cggugagcgcucgcuggc

SEQ ID NO: 1060 - RNA, 24 nt, Artificial Sequence
  Synthetic Construct
acauccugcuccacagggcagagg

SEQ ID NO: 1061 - RNA, 22 nt, Artificial Sequence
  Synthetic Construct
ucuggcuaucucacgagacugu

SEQ ID NO: 1062 - RNA, 21 nt, Artificial Sequence
  Synthetic Construct
agaaguggcuaauaauauuga

SEQ ID NO: 1063 - RNA, 22 nt, Artificial Sequence
  Synthetic Construct
uaaaguggcagaguauagacac

SEQ ID NO: 1064 - RNA, 21 nt, Artificial Sequence
  Synthetic Construct
gacagagugccacuuacugaa

SEQ ID NO: 1065 - RNA, 22 nt, Artificial Sequence
  Synthetic Construct
uucgguauacuuugugaauugg

SEQ ID NO: 1066 - RNA, 22 nt, Artificial Sequence
  Synthetic Construct
aucuaaaugcagcaugccaguc

SEQ ID NO: 1067 - RNA, 19 nt, Artificial Sequence
  Synthetic Construct
cauccguccgucuguccac

SEQ ID NO: 1068 - RNA, 22 nt, Artificial Sequence
  Synthetic Construct
uacacaagaaaaccaaggcuca

SEQ ID NO: 1069 - RNA, 22 nt, Artificial Sequence
  Synthetic Construct
uauggagguucuagaccauguu

SEQ ID NO: 1070 - RNA, 21 nt, Artificial Sequence
  Synthetic Construct
uaacauaauaguguggauuga

SEQ ID NO: 1071 - RNA, 21 nt, Artificial Sequence
  Synthetic Construct
ugcuuaaccuugcccucgaaa

SEQ ID NO: 1072 - RNA, 21 nt, Artificial Sequence
  Synthetic Construct
ucacuccucuccucccgucuu

SEQ ID NO: 1073 - RNA, 22 nt, Artificial Sequence
  Synthetic Construct
ucaggcucaguccccucccgau

SEQ ID NO: 1074 - RNA, 22 nt, Artificial Sequence
  Synthetic Construct
agaggcuggccgugaugaauuc

SEQ ID NO: 1075 - RNA, 21 nt, Artificial Sequence
  Synthetic Construct
cggggcagcucaguacaggau

SEQ ID NO: 1076 - RNA, 22 nt, Artificial Sequence
  Synthetic Construct
gugguuaucccugcuguguucg

SEQ ID NO: 1077 - RNA, 22 nt, Artificial Sequence
  Synthetic Construct
gugguuaucccuguccuguucg

SEQ ID NO: 1078 - RNA, 21 nt, Artificial Sequence
  Synthetic Construct
uugaaaggcuauuucuugguc

SEQ ID NO: 1079 - RNA, 22 nt, Artificial Sequence
  Synthetic Construct
gugacaucacauauacggcagc

SEQ ID NO: 1080 - RNA, 20 nt, Artificial Sequence
  Synthetic Construct
ccauggaucuccaggugggu

SEQ ID NO: 1081 - RNA, 22 nt, Artificial Sequence
  Synthetic Construct
aguggggaacccuuccaugagg

SEQ ID NO: 1082 - RNA, 23 nt, Artificial Sequence
  Synthetic Construct
aggaccugcgggacaagauucuu

SEQ ID NO: 1083 - RNA, 22 nt, Artificial Sequence
  Synthetic Construct
ugaaggucuacugugugccagg

SEQ ID NO: 1084 - RNA, 23 nt, Artificial Sequence
  Synthetic Construct
agguuguccguguugucuucucu

SEQ ID NO: 1085 - RNA, 22 nt, Artificial Sequence
  Synthetic Construct
gaaguugcccauguuauuuucg

SEQ ID NO: 1086 - RNA, 22 nt, Artificial Sequence
  Synthetic Construct
ugaguauuacauggccaaucuc

SEQ ID NO: 1087 - RNA, 21 nt, Artificial Sequence
  Synthetic Construct
cagcagcacacugugguuugu

SEQ ID NO: 1088 - RNA, 23 nt, Artificial Sequence
  Synthetic Construct
uuucaagccagggggcguuuuuc

SEQ ID NO: 1089 - RNA, 21 nt, Artificial Sequence
  Synthetic Construct
ugcuguauugucagguaguga

SEQ ID NO: 1090 - RNA, 21 nt, Artificial Sequence
  Synthetic Construct
uuaagacuugcagugauguuu

SEQ ID NO: 1091 - RNA, 21 nt, Artificial Sequence
  Synthetic Construct
acagacuugcugugauguuca

SEQ ID NO: 1092 - RNA, 22 nt, Artificial Sequence
  Synthetic Construct
ucaggacacuucugaacuugga

SEQ ID NO: 1093 - RNA, 24 nt, Artificial Sequence
  Synthetic Construct
agggcuggacucagcggcggagcu

SEQ ID NO: 1094 - RNA, 21 nt, Artificial Sequence
  Synthetic Construct
ugacugccucacugaccacuu

SEQ ID NO: 1095 - RNA, 23 nt, Artificial Sequence
  Synthetic Construct
ucacaacaaccuugcaggguaga

SEQ ID NO: 1096 - RNA, 22 nt, Artificial Sequence
  Synthetic Construct
cuuggauuuuccugggccucag

SEQ ID NO: 1097 - RNA, 21 nt, Artificial Sequence
  Synthetic Construct
uugccagggcaggagguggaa

SEQ ID NO: 1098 - RNA, 22 nt, Artificial Sequence
  Synthetic Construct
uagagucuggcugauaugguuu

SEQ ID NO: 1099 - RNA, 22 nt, Artificial Sequence
  Synthetic Construct
ugaggcccuuggggcacagugg

SEQ ID NO: 1100 - RNA, 22 nt, Artificial Sequence
  Synthetic Construct
uccuaaaucugaaaguccaaaa

SEQ ID NO: 1101 - RNA, 22 nt, Artificial Sequence
  Synthetic Construct
augcaccugggcaaggauucug

SEQ ID NO: 1102 - RNA, 18 nt, Artificial Sequence
  Synthetic Construct
aauccuugcuaccugggu

SEQ ID NO: 1103 - RNA, 22 nt, Artificial Sequence
  Synthetic Construct
aaugcacccgggcaaggauucu

SEQ ID NO: 1104 - RNA, 22 nt, Artificial Sequence
  Synthetic Construct
agggggauggcagagcaaaauu

SEQ ID NO: 1105 - RNA, 21 nt, Artificial Sequence
  Synthetic Construct
uauauauacagccaugcacuc

SEQ ID NO: 1106 - RNA, 22 nt, Artificial Sequence
  Synthetic Construct
aaugcaccugggcaaggauuca

SEQ ID NO: 1107 - RNA, 23 nt, Artificial Sequence
  Synthetic Construct
uagcagcgggaacaguucugcag

SEQ ID NO: 1108 - RNA, 21 nt, Artificial Sequence
  Synthetic Construct
gggagugcagggcaggguuuc

SEQ ID NO: 1109 - RNA, 21 nt, Artificial Sequence
  Synthetic Construct
uugcagcugcgguuguaaggu

SEQ ID NO: 1110 - RNA, 22 nt, Artificial Sequence
  Synthetic Construct
cgucaacacuugcugguuuccu

SEQ ID NO: 1111 - RNA, 21 nt, Artificial Sequence
  Synthetic Construct
uaaggcacccuucugaguaga

SEQ ID NO: 1112 - RNA, 21 nt, Artificial Sequence
  Synthetic Construct
uuuugcaccuuuuggagugaa

SEQ ID NO: 1113 - RNA, 23 nt, Artificial Sequence
  Synthetic Construct
ugauuguagccuuuuggaguaga

SEQ ID NO: 1114 - RNA, 23 nt, Artificial Sequence
  Synthetic Construct
ggguuuguagcuuugcuggcaug

SEQ ID NO: 1115 - RNA, 21 nt, Artificial Sequence
  Synthetic Construct
ucccuucuuccugggcccuca

SEQ ID NO: 1116 - RNA, 21 nt, Artificial Sequence
  Synthetic Construct
gugggauuucugaguagcauc

SEQ ID NO: 1117 - RNA, 22 nt, Artificial Sequence
  Synthetic Construct
ugauugguacgucuguggguag

SEQ ID NO: 1118 - RNA, 22 nt, Artificial Sequence
  Synthetic Construct
ugauugguacgucuguggguag

SEQ ID NO: 1119 - RNA, 23 nt, Artificial Sequence
  Synthetic Construct
ccggggcagauugguguagggug

SEQ ID NO: 1120 - RNA, 23 nt, Artificial Sequence
  Synthetic Construct
acggagacgacaagacugugcug

SEQ ID NO: 1121 - RNA, 22 nt, Artificial Sequence
  Synthetic Construct
aauccacgcugagcuuggcauc

SEQ ID NO: 1122 - RNA, 23 nt, Artificial Sequence
  Synthetic Construct
aggaaaugaggcuggcuaggagc

SEQ ID NO: 1123 - RNA, 22 nt, Artificial Sequence
  Synthetic Construct
aaucagugaaugccuugaaccu

SEQ ID NO: 1124 - RNA, 21 nt, Artificial Sequence
  Synthetic Construct
uuacaggcgugaaccaccgcg

SEQ ID NO: 1125 - RNA, 21 nt, Artificial Sequence
  Synthetic Construct
guuucaccauguuggucaggc

SEQ ID NO: 1126 - RNA, 22 nt, Artificial Sequence
  Synthetic Construct
uacucaggagaguggcaaucac

SEQ ID NO: 1127 - RNA, 22 nt, Artificial Sequence
  Synthetic Construct
uucagaucccagcggugccucu

SEQ ID NO: 1128 - RNA, 21 nt, Artificial Sequence
  Synthetic Construct
gugucuuuugcucugcaguca

SEQ ID NO: 1129 - RNA, 22 nt, Artificial Sequence
  Synthetic Construct
aagugcugucauagcugagguc

SEQ ID NO: 1130 - RNA, 23 nt, Artificial Sequence
  Synthetic Construct
uaaauuucaccuuucugagaagg

SEQ ID NO: 1131 - RNA, 22 nt, Artificial Sequence
  Synthetic Construct
aaaugucaccuuuuugagagga

SEQ ID NO: 1132 - RNA, 22 nt, Artificial Sequence
  Synthetic Construct
uucucaaggaggugucguuuau

SEQ ID NO: 1133 - RNA, 21 nt, Artificial Sequence
  Synthetic Construct
auugacacuucugugaguaga

SEQ ID NO: 1134 - RNA, 21 nt, Artificial Sequence
  Synthetic Construct
auugacaccucugugagugga

SEQ ID NO: 1135 - RNA, 22 nt, Artificial Sequence
  Synthetic Construct
gagugccuucuuuuggagcguu

SEQ ID NO: 1136 - RNA, 23 nt, Artificial Sequence
  Synthetic Construct
uucucgaggaaagaagcacuuuc

SEQ ID NO: 1137 - RNA, 22 nt, Artificial Sequence
  Synthetic Construct
aucuggagguaagaagcacuuu

SEQ ID NO: 1138 - RNA, 22 nt, Artificial Sequence
  Synthetic Construct
aucgugcaucccuuuagagugu

SEQ ID NO: 1139 - RNA, 22 nt, Artificial Sequence
  Synthetic Construct
aucgugcaucccuuuagagugu

SEQ ID NO: 1140 - RNA, 22 nt, Artificial Sequence
  Synthetic Construct
aucgugcauccuuuuagagugu

SEQ ID NO: 1141 - RNA, 21 nt, Artificial Sequence
  Synthetic Construct
agagauugguagaaaucaggu

SEQ ID NO: 1142 - RNA, 21 nt, Artificial Sequence
  Synthetic Construct
acugaauccucuuuuccucag

SEQ ID NO: 1143 - RNA, 23 nt, Artificial Sequence
  Synthetic Construct
aaucggacccauuuaaaccggag

SEQ ID NO: 1144 - RNA, 24 nt, Artificial Sequence
  Synthetic Construct
ucugggcacaggcggauggacagg

SEQ ID NO: 1145 - RNA, 22 nt, Artificial Sequence
  Synthetic Construct
gaaagcgcuucccuuugcugga

SEQ ID NO: 1146 - RNA, 22 nt, Artificial Sequence
  Synthetic Construct
caaagcgcuccccuuuagaggu

SEQ ID NO: 1147 - RNA, 23 nt, Artificial Sequence
  Synthetic Construct
caaagcgcuucucuuuagagugu

SEQ ID NO: 1148 - RNA, 22 nt, Artificial Sequence
  Synthetic Construct
cucuagagggaagcacuuucug

SEQ ID NO: 1149 - RNA, 22 nt, Artificial Sequence
  Synthetic Construct
cucuagagggaagcgcuuucug

SEQ ID NO: 1150 - RNA, 22 nt, Artificial Sequence
  Synthetic Construct
cucuagagggaagcacuuucuc

SEQ ID NO: 1151 - RNA, 21 nt, Artificial Sequence
  Synthetic Construct
ccagugacugagcuggagcca

SEQ ID NO: 1152 - RNA, 22 nt, Artificial Sequence
  Synthetic Construct
aggauaggaagaaugaagugcu

SEQ ID NO: 1153 - RNA, 22 nt, Artificial Sequence
  Synthetic Construct
aggagaguggauuccagguggu

SEQ ID NO: 1154 - RNA, 22 nt, Artificial Sequence
  Synthetic Construct
uccuccucuaccucaucccagu

SEQ ID NO: 1155 - RNA, 22 nt, Artificial Sequence
  Synthetic Construct
ugagggguuuggaaugggaugg

SEQ ID NO: 1156 - RNA, 22 nt, Artificial Sequence
  Synthetic Construct
aaccccuaaggcaacuggaugg

SEQ ID NO: 1157 - RNA, 22 nt, Artificial Sequence
  Synthetic Construct
agggaaggggacgaggguuggg

SEQ ID NO: 1158 - RNA, 23 nt, Artificial Sequence
  Synthetic Construct
aagaagagacugagucaucgaau

SEQ ID NO: 1159 - RNA, 22 nt, Artificial Sequence
  Synthetic Construct
cucuagagggaagcgcuuucug

SEQ ID NO: 1160 - RNA, 22 nt, Artificial Sequence
  Synthetic Construct
aaagugcauccuuuuagagguu

SEQ ID NO: 1161 - RNA, 22 nt, Artificial Sequence
  Synthetic Construct
aaagugcaucuuuuuagaggau

SEQ ID NO: 1162 - RNA, 22 nt, Artificial Sequence
  Synthetic Construct
caaagugccucccuuuagagug

SEQ ID NO: 1163 - RNA, 22 nt, Artificial Sequence
  Synthetic Construct
uucuccaaaagggagcacuuuc

SEQ ID NO: 1164 - RNA, 22 nt, Artificial Sequence
  Synthetic Construct
aaagugcuucccuuuggacugu

SEQ ID NO: 1165 - RNA, 21 nt, Artificial Sequence
  Synthetic Construct
aaagugcuuccuuuuagaggg

SEQ ID NO: 1166 - RNA, 22 nt, Artificial Sequence
  Synthetic Construct
cucuagagggaagcacuuucug

SEQ ID NO: 1167 - RNA, 20 nt, Artificial Sequence
  Synthetic Construct
cuacaaagggaagcccuuuc

SEQ ID NO: 1168 - RNA, 21 nt, Artificial Sequence
  Synthetic Construct
aaagugcuuccuuuuugaggg

SEQ ID NO: 1169 - RNA, 22 nt, Artificial Sequence
  Synthetic Construct
ccucuaaagggaagcgcuuucu

SEQ ID NO: 1170 - RNA, 23 nt, Artificial Sequence
  Synthetic Construct
ucuagaggaagcacuuucuguuu

SEQ ID NO: 1171 - RNA, 22 nt, Artificial Sequence
  Synthetic Construct
acaaagugcuucccuuuagagu

SEQ ID NO: 1172 - RNA, 22 nt, Artificial Sequence
  Synthetic Construct
aacgcacuucccuuuagagugu

SEQ ID NO: 1173 - RNA, 22 nt, Artificial Sequence
  Synthetic Construct
cucuagagggaagcgcuuucug

SEQ ID NO: 1174 - RNA, 22 nt, Artificial Sequence
  Synthetic Construct
cucuagagggaagcgcuuucug

SEQ ID NO: 1175 - RNA, 21 nt, Artificial Sequence
  Synthetic Construct
gaaggcgcuucccuuuggagu

SEQ ID NO: 1176 - RNA, 21 nt, Artificial Sequence
  Synthetic Construct
cuccagagggaugcacuuucu

SEQ ID NO: 1177 - RNA, 22 nt, Artificial Sequence
  Synthetic Construct
cucuagagggaagcacuuucug

SEQ ID NO: 1178 - RNA, 22 nt, Artificial Sequence
  Synthetic Construct
gaaagugcuuccuuuuagaggc

SEQ ID NO: 1179 - RNA, 20 nt, Artificial Sequence
  Synthetic Construct
cugcaaagggaagcccuuuc

SEQ ID NO: 1180 - RNA, 22 nt, Artificial Sequence
  Synthetic Construct
ccucccacacccaaggcuugca

SEQ ID NO: 1181 - RNA, 22 nt, Artificial Sequence
  Synthetic Construct
ggagaaauuauccuuggugugu

SEQ ID NO: 1182 - RNA, 22 nt, Artificial Sequence
  Synthetic Construct
uggugggcacagaaucuggacu

SEQ ID NO: 1183 - RNA, 22 nt, Artificial Sequence
  Synthetic Construct
ugugacagauugauaacugaaa

SEQ ID NO: 1184 - RNA, 22 nt, Artificial Sequence
  Synthetic Construct
aaacauucgcggugcacuucuu

SEQ ID NO: 1185 - RNA, 22 nt, Artificial Sequence
  Synthetic Construct
auucugcauuuuuagcaaguuc

SEQ ID NO: 1186 - RNA, 22 nt, Artificial Sequence
  Synthetic Construct
accugagguugugcauuucuaa

SEQ ID NO: 1187 - RNA, 22 nt, Artificial Sequence
  Synthetic Construct
ucaguaaauguuuauuagauga

SEQ ID NO: 1188 - RNA, 22 nt, Artificial Sequence
  Synthetic Construct
caaaacuggcaauuacuuuugc

SEQ ID NO: 1189 - RNA, 25 nt, Artificial Sequence
  Synthetic Construct
aaaaaccacaauuacuuuugcacca

SEQ ID NO: 1190 - RNA, 22 nt, Artificial Sequence
  Synthetic Construct
aaaaguaauuguggauuuugcu

SEQ ID NO: 1191 - RNA, 22 nt, Artificial Sequence
  Synthetic Construct
caaaaaccggcaauuacuuuug

SEQ ID NO: 1192 - RNA, 20 nt, Artificial Sequence
  Synthetic Construct
aaaaguaauugugguuuuug

SEQ ID NO: 1193 - RNA, 21 nt, Artificial Sequence
  Synthetic Construct
caaaaacugcaauuacuuuca

SEQ ID NO: 1194 - RNA, 21 nt, Artificial Sequence
  Synthetic Construct
aaagguaauugugguuucugc

SEQ ID NO: 1195 - RNA, 22 nt, Artificial Sequence
  Synthetic Construct
caaaaacugcaguuacuuuugc

SEQ ID NO: 1196 - RNA, 22 nt, Artificial Sequence
  Synthetic Construct
aaagguaauugcaguuuuuccc

SEQ ID NO: 1197 - RNA, 23 nt, Artificial Sequence
  Synthetic Construct
ugcaaaaguaauugcaguuuuug

SEQ ID NO: 1198 - RNA, 21 nt, Artificial Sequence
  Synthetic Construct
aaaaguaacugcgguuuuuga

SEQ ID NO: 1199 - RNA, 22 nt, Artificial Sequence
  Synthetic Construct
aacggcaaugacuuuuguacca

SEQ ID NO: 1200 - RNA, 22 nt, Artificial Sequence
  Synthetic Construct
aaaaguaauugcgguuuuugcc

SEQ ID NO: 1201 - RNA, 20 nt, Artificial Sequence
  Synthetic Construct
aaaaggcauugugguuuuug

SEQ ID NO: 1202 - RNA, 22 nt, Artificial Sequence
  Synthetic Construct
agaaguaacuacgguuuuugca

SEQ ID NO: 1203 - RNA, 19 nt, Artificial Sequence
  Synthetic Construct
aaaaguaauugcggucuuu

SEQ ID NO: 1204 - RNA, 22 nt, Artificial Sequence
  Synthetic Construct
gaaaguaauugcuguuuuugcc

SEQ ID NO: 1205 - RNA, 21 nt, Artificial Sequence
  Synthetic Construct
aaaaguaauugcaguuuuugc

SEQ ID NO: 1206 - RNA, 22 nt, Artificial Sequence
  Synthetic Construct
uaaaacccacaauuauguuugu

SEQ ID NO: 1207 - RNA, 22 nt, Artificial Sequence
  Synthetic Construct
aaaaguuauugcgguuuuggcu

SEQ ID NO: 1208 - RNA, 21 nt, Artificial Sequence
  Synthetic Construct
uggcaguuacuuuugcaccag

SEQ ID NO: 1209 - RNA, 20 nt, Artificial Sequence
  Synthetic Construct
aaaacugcaguuacuuuugc

SEQ ID NO: 1210 - RNA, 20 nt, Artificial Sequence
  Synthetic Construct
gugcaaaagucaucacgguu

SEQ ID NO: 1211 - RNA, 22 nt, Artificial Sequence
  Synthetic Construct
agaaguaauugcgguuuugcca

SEQ ID NO: 1212 - RNA, 22 nt, Artificial Sequence
  Synthetic Construct
caaaaccgcgauuacucuugca

SEQ ID NO: 1213 - RNA, 21 nt, Artificial Sequence
  Synthetic Construct
aaaaacugcaaucacuuuugc

SEQ ID NO: 1214 - RNA, 22 nt, Artificial Sequence
  Synthetic Construct
aaaaguaauugugguuuuggcc

SEQ ID NO: 1215 - RNA, 22 nt, Artificial Sequence
  Synthetic Construct
aaagguaacugugauuuuugcu

SEQ ID NO: 1216 - RNA, 22 nt, Artificial Sequence
  Synthetic Construct
aaaaguaacuaugguuuuugcc

SEQ ID NO: 1217 - RNA, 22 nt, Artificial Sequence
  Synthetic Construct
aaaaguaauugcgguuuuugcc

SEQ ID NO: 1218 - RNA, 22 nt, Artificial Sequence
  Synthetic Construct
caaaaaccacaguuucuuuugc

SEQ ID NO: 1219 - RNA, 22 nt, Artificial Sequence
  Synthetic Construct
aaaaacugagacuacuuuugca

SEQ ID NO: 1220 - RNA, 19 nt, Artificial Sequence
  Synthetic Construct
aaaaacuguaauuacuuuu

SEQ ID NO: 1221 - RNA, 23 nt, Artificial Sequence
  Synthetic Construct
ugcaaaaguaauugcaguuuuug

SEQ ID NO: 1222 - RNA, 23 nt, Artificial Sequence
  Synthetic Construct
caaaaaccgcaauuacuuuugca

SEQ ID NO: 1223 - RNA, 22 nt, Artificial Sequence
  Synthetic Construct
aaaaguaauugcggauuuugcc

SEQ ID NO: 1224 - RNA, 21 nt, Artificial Sequence
  Synthetic Construct
caaaaacugcauuacuuuugc

SEQ ID NO: 1225 - RNA, 22 nt, Artificial Sequence
  Synthetic Construct
aaaaguacuugcggauuuugcu

SEQ ID NO: 1226 - RNA, 22 nt, Artificial Sequence
  Synthetic Construct
aaaaguauuugcggguuuuguc

SEQ ID NO: 1227 - RNA, 21 nt, Artificial Sequence
  Synthetic Construct
caaagguauuugugguuuuug

SEQ ID NO: 1228 - RNA, 22 nt, Artificial Sequence
  Synthetic Construct
caaaaguaauuguggauuuugu

SEQ ID NO: 1229 - RNA, 22 nt, Artificial Sequence
  Synthetic Construct
ccaaaacugcaguuacuuuugc

SEQ ID NO: 1230 - RNA, 22 nt, Artificial Sequence
  Synthetic Construct
uagcaaaaacugcaguuacuuu

SEQ ID NO: 1231 - RNA, 22 nt, Artificial Sequence
  Synthetic Construct
gcuggugcaaaaguaauggcgg

SEQ ID NO: 1232 - RNA, 23 nt, Artificial Sequence
  Synthetic Construct
auggccaaaacugcaguuauuuu

SEQ ID NO: 1233 - RNA, 25 nt, Artificial Sequence
  Synthetic Construct
aaaaaccacaauuacuuuugcacca

SEQ ID NO: 1234 - RNA, 23 nt, Artificial Sequence
  Synthetic Construct
caaagacugcaauuacuuuugcg

SEQ ID NO: 1235 - RNA, 22 nt, Artificial Sequence
  Synthetic Construct
agcuacaguuacuuuugcacca

SEQ ID NO: 1236 - RNA, 23 nt, Artificial Sequence
  Synthetic Construct
aaaaguaacugcgguuuuugccu

SEQ ID NO: 1237 - RNA, 23 nt, Artificial Sequence
  Synthetic Construct
ugcaaaaguaauugcaguuuuug

SEQ ID NO: 1238 - RNA, 22 nt, Artificial Sequence
  Synthetic Construct
aaaaguaaucacuguuuuugcc

SEQ ID NO: 1239 - RNA, 23 nt, Artificial Sequence
  Synthetic Construct
caaaaaccgcaauuacuuuugca

SEQ ID NO: 1240 - RNA, 21 nt, Artificial Sequence
  Synthetic Construct
ugacaacuauggaugagcucu

SEQ ID NO: 1241 - RNA, 22 nt, Artificial Sequence
  Synthetic Construct
ugucuuacucccucaggcacau

SEQ ID NO: 1242 - RNA, 22 nt, Artificial Sequence
  Synthetic Construct
ugucuuacucccucaggcacau

SEQ ID NO: 1243 - RNA, 20 nt, Artificial Sequence
  Synthetic Construct
ucuuacucccucaggcacug

SEQ ID NO: 1244 - RNA, 21 nt, Artificial Sequence
  Synthetic Construct
gcgacccacucuugguuucca

SEQ ID NO: 1245 - RNA, 22 nt, Artificial Sequence
  Synthetic Construct
gaaaucaagcgugggugagacc

SEQ ID NO: 1246 - RNA, 21 nt, Artificial Sequence
  Synthetic Construct
guuuaaccuuuugccuguugg

SEQ ID NO: 1247 - RNA, 21 nt, Artificial Sequence
  Synthetic Construct
aaaacggugagauuuuguuuu

SEQ ID NO: 1248 - RNA, 21 nt, Artificial Sequence
  Synthetic Construct
gcuaguccugacucagccagu

SEQ ID NO: 1249 - RNA, 21 nt, Artificial Sequence
  Synthetic Construct
aggguaagcugaaccucugau

SEQ ID NO: 1250 - RNA, 22 nt, Artificial Sequence
  Synthetic Construct
gaugagcucauuguaauaugag

SEQ ID NO: 1251 - RNA, 23 nt, Artificial Sequence
  Synthetic Construct
guuugcacgggugggccuugucu

SEQ ID NO: 1252 - RNA, 19 nt, Artificial Sequence
  Synthetic Construct
guccuaggaggcuccucug

SEQ ID NO: 1253 - RNA, 21 nt, Artificial Sequence
  Synthetic Construct
guuggggugcaggggucugcu

SEQ ID NO: 1254 - RNA, 21 nt, Artificial Sequence
  Synthetic Construct
uaugguacuccuuaagcuaac

SEQ ID NO: 1255 - RNA, 19 nt, Artificial Sequence
  Synthetic Construct
ugagcugcuguaccaaaau

SEQ ID NO: 1256 - RNA, 22 nt, Artificial Sequence
  Synthetic Construct
cacauaugaagugagccagcac

SEQ ID NO: 1257 - RNA, 22 nt, Artificial Sequence
  Synthetic Construct
agccuuccaggagaaauggaga

SEQ ID NO: 1258 - RNA, 22 nt, Artificial Sequence
  Synthetic Construct
uaaaacuuuaagugugccuagg

SEQ ID NO: 1259 - RNA, 22 nt, Artificial Sequence
  Synthetic Construct
gaauauggguauauuaguuugg

SEQ ID NO: 1260 - RNA, 22 nt, Artificial Sequence
  Synthetic Construct
cagggaaaugggaagaacuaga

SEQ ID NO: 1261 - RNA, 22 nt, Artificial Sequence
  Synthetic Construct
cugaauagcugggacuacaggu

SEQ ID NO: 1262 - RNA, 22 nt, Artificial Sequence
  Synthetic Construct
uauccagcuuguuacuauaugc

SEQ ID NO: 1263 - RNA, 18 nt, Artificial Sequence
  Synthetic Construct
auggucaccuccgggacu

SEQ ID NO: 1264 - RNA, 21 nt, Artificial Sequence
  Synthetic Construct
acuggcauuagugggacuuuu

SEQ ID NO: 1265 - RNA, 21 nt, Artificial Sequence
  Synthetic Construct
ggcugggugcucuugugcagu

SEQ ID NO: 1266 - RNA, 21 nt, Artificial Sequence
  Synthetic Construct
uaaaguaaauaugcaccaaaa

SEQ ID NO: 1267 - RNA, 21 nt, Artificial Sequence
  Synthetic Construct
aauaaaguucauguauggcaa

SEQ ID NO: 1268 - RNA, 21 nt, Artificial Sequence
  Synthetic Construct
ugggagcuaagcuauggguau

SEQ ID NO: 1269 - RNA, 22 nt, Artificial Sequence
  Synthetic Construct
caaaguuuaagauccuugaagu

SEQ ID NO: 1270 - RNA, 20 nt, Artificial Sequence
  Synthetic Construct
aaaguagcuguaccauuugc

SEQ ID NO: 1271 - RNA, 19 nt, Artificial Sequence
  Synthetic Construct
agguugacauacguuuccc

SEQ ID NO: 1272 - RNA, 19 nt, Artificial Sequence
  Synthetic Construct
aggcacggugucagcaggc

SEQ ID NO: 1273 - RNA, 19 nt, Artificial Sequence
  Synthetic Construct
gggcgccugugaucccaac

SEQ ID NO: 1274 - RNA, 23 nt, Artificial Sequence
  Synthetic Construct
aguauguucuuccaggacagaac

SEQ ID NO: 1275 - RNA, 20 nt, Artificial Sequence
  Synthetic Construct
auguauaaauguauacacac

SEQ ID NO: 1276 - RNA, 22 nt, Artificial Sequence
  Synthetic Construct
gagaaaugcuggacuaaucugc

SEQ ID NO: 1277 - RNA, 22 nt, Artificial Sequence
  Synthetic Construct
agaaaggguggcaauaccucuu

SEQ ID NO: 1278 - RNA, 22 nt, Artificial Sequence
  Synthetic Construct
agguauugccacccuuucuagu

SEQ ID NO: 1279 - RNA, 22 nt, Artificial Sequence
  Synthetic Construct
guagcaccuugcaggauaaggu

SEQ ID NO: 1280 - RNA, 24 nt, Artificial Sequence
  Synthetic Construct
uacagaugcagauucucugacuuc

SEQ ID NO: 1281 - RNA, 20 nt, Artificial Sequence
  Synthetic Construct
aacucuagccugagcaacag

SEQ ID NO: 1282 - RNA, 22 nt, Artificial Sequence
  Synthetic Construct
acagcccagcaguuaucacggg

SEQ ID NO: 1283 - RNA, 22 nt, Artificial Sequence
  Synthetic Construct
uuagaacguuuuagggucaaau

SEQ ID NO: 1284 - RNA, 22 nt, Artificial Sequence
  Synthetic Construct
uaacaaacaccuguaaaacagc

SEQ ID NO: 1285 - RNA, 22 nt, Artificial Sequence
  Synthetic Construct
agcauacaccuguaguccuaga

SEQ ID NO: 1286 - RNA, 21 nt, Artificial Sequence
  Synthetic Construct
aguuaaugaauccuggaaagu

SEQ ID NO: 1287 - RNA, 21 nt, Artificial Sequence
  Synthetic Construct
ucagcuacuaccucuauuagg

SEQ ID NO: 1288 - RNA, 22 nt, Artificial Sequence
  Synthetic Construct
uugcucugagcuccgagaaagc

SEQ ID NO: 1289 - RNA, 22 nt, Artificial Sequence
  Synthetic Construct
caaauaauaccacagugggugu

SEQ ID NO: 1290 - RNA, 20 nt, Artificial Sequence
  Synthetic Construct
aauaauaucacaguaggugu

SEQ ID NO: 1291 - RNA, 22 nt, Artificial Sequence
  Synthetic Construct
aauaauaucacaguagguguac

SEQ ID NO: 1292 - RNA, 22 nt, Artificial Sequence
  Synthetic Construct
gcaguggcucugaaaugaacuc

SEQ ID NO: 1293 - RNA, 21 nt, Artificial Sequence
  Synthetic Construct
cagaucaugggacugucucag

SEQ ID NO: 1294 - RNA, 22 nt, Artificial Sequence
  Synthetic Construct
acuccaagaagaaucuagacag

SEQ ID NO: 1295 - RNA, 22 nt, Artificial Sequence
  Synthetic Construct
cucauuuaaguagucugaugcc

SEQ ID NO: 1296 - RNA, 22 nt, Artificial Sequence
  Synthetic Construct
ucaaguaguuucaugauaaagg

SEQ ID NO: 1297 - RNA, 22 nt, Artificial Sequence
  Synthetic Construct
ugggggagugcagugauugugg

SEQ ID NO: 1298 - RNA, 22 nt, Artificial Sequence
  Synthetic Construct
uccugucuuuccuuguuggagc

SEQ ID NO: 1299 - RNA, 22 nt, Artificial Sequence
  Synthetic Construct
cgaaaacagcaauuaccuuugc

SEQ ID NO: 1300 - RNA, 22 nt, Artificial Sequence
  Synthetic Construct
uaaugcauuaaauuauugaagg

SEQ ID NO: 1301 - RNA, 19 nt, Artificial Sequence
  Synthetic Construct
uuauugucacguucugauu

SEQ ID NO: 1302 - RNA, 22 nt, Artificial Sequence
  Synthetic Construct
ugagucagcaacauaucccaug

SEQ ID NO: 1303 - RNA, 18 nt, Artificial Sequence
  Synthetic Construct
aggagaagucgggaaggu

SEQ ID NO: 1304 - RNA, 22 nt, Artificial Sequence
  Synthetic Construct
uuaggccaucaucccauuaugc

SEQ ID NO: 1305 - RNA, 23 nt, Artificial Sequence
  Synthetic Construct
uguuucggggcucauggccugug

SEQ ID NO: 1306 - RNA, 22 nt, Artificial Sequence
  Synthetic Construct
uucuggauaacaugcugaagcu

SEQ ID NO: 1307 - RNA, 22 nt, Artificial Sequence
  Synthetic Construct
acguuugaaugcuguacaaggc

SEQ ID NO: 1308 - RNA, 20 nt, Artificial Sequence
  Synthetic Construct
augagcgacugugccugacc

SEQ ID NO: 1309 - RNA, 21 nt, Artificial Sequence
  Synthetic Construct
ugaguuggccaucugagugag

SEQ ID NO: 1310 - RNA, 20 nt, Artificial Sequence
  Synthetic Construct
guccgcucggcgguggccca

SEQ ID NO: 1311 - RNA, 24 nt, Artificial Sequence
  Synthetic Construct
cugaagugauguguaacugaucag

SEQ ID NO: 1312 - RNA, 20 nt, Artificial Sequence
  Synthetic Construct
gcggagagagaauggggagc

SEQ ID NO: 1313 - RNA, 23 nt, Artificial Sequence
  Synthetic Construct
ugagugugugugugugagugugu

SEQ ID NO: 1314 - RNA, 19 nt, Artificial Sequence
  Synthetic Construct
gagccaguuggacaggagc

SEQ ID NO: 1315 - RNA, 22 nt, Artificial Sequence
  Synthetic Construct
aagauguggaaaaauuggaauc

SEQ ID NO: 1316 - RNA, 21 nt, Artificial Sequence
  Synthetic Construct
uagauaaaauauugguaccug

SEQ ID NO: 1317 - RNA, 21 nt, Artificial Sequence
  Synthetic Construct
cuucuugugcucuaggauugu

SEQ ID NO: 1318 - RNA, 20 nt, Artificial Sequence
  Synthetic Construct
gggcuggggcgcggggaggu

SEQ ID NO: 1319 - RNA, 23 nt, Artificial Sequence
  Synthetic Construct
uucauuugguauaaaccgcgauu

SEQ ID NO: 1320 - RNA, 22 nt, Artificial Sequence
  Synthetic Construct
uaaugauucaucagacucagau

SEQ ID NO: 1321 - RNA, 21 nt, Artificial Sequence
  Synthetic Construct
ucuuguguucucuagaucagu

SEQ ID NO: 1322 - RNA, 23 nt, Artificial Sequence
  Synthetic Construct
uuacaguuguucaaccaguuacu

SEQ ID NO: 1323 - RNA, 21 nt, Artificial Sequence
  Synthetic Construct
caaagaggaaggucccauuac

SEQ ID NO: 1324 - RNA, 22 nt, Artificial Sequence
  Synthetic Construct
uuaugguuugccugggacugag

SEQ ID NO: 1325 - RNA, 19 nt, Artificial Sequence
  Synthetic Construct
ugggcguaucuguaugcua

SEQ ID NO: 1326 - RNA, 22 nt, Artificial Sequence
  Synthetic Construct
uaugcauuguauuuuuaggucc

SEQ ID NO: 1327 - RNA, 21 nt, Artificial Sequence
  Synthetic Construct
uuuccauaggugaugagucac

SEQ ID NO: 1328 - RNA, 21 nt, Artificial Sequence
  Synthetic Construct
uuggccacaauggguuagaac

SEQ ID NO: 1329 - RNA, 24 nt, Artificial Sequence
  Synthetic Construct
ucagaacaaaugccgguucccaga

SEQ ID NO: 1330 - RNA, 22 nt, Artificial Sequence
  Synthetic Construct
gagcuuauucauaaaagugcag

SEQ ID NO: 1331 - RNA, 20 nt, Artificial Sequence
  Synthetic Construct
agaccauggguucucauugu

SEQ ID NO: 1332 - RNA, 22 nt, Artificial Sequence
  Synthetic Construct
uugugucaauaugcgaugaugu

SEQ ID NO: 1333 - RNA, 19 nt, Artificial Sequence
  Synthetic Construct
ugucucugcugggguuucu

SEQ ID NO: 1334 - RNA, 21 nt, Artificial Sequence
  Synthetic Construct
gaagugugccguggugugucu

SEQ ID NO: 1335 - RNA, 21 nt, Artificial Sequence
  Synthetic Construct
aagccugcccggcuccucggg

SEQ ID NO: 1336 - RNA, 23 nt, Artificial Sequence
  Synthetic Construct
ugguucucuuguggcucaagcgu

SEQ ID NO: 1337 - RNA, 22 nt, Artificial Sequence
  Synthetic Construct
uacgucaucguugucaucguca

SEQ ID NO: 1338 - RNA, 20 nt, Artificial Sequence
  Synthetic Construct
guugugucaguuuaucaaac

SEQ ID NO: 1339 - RNA, 23 nt, Artificial Sequence
  Synthetic Construct
acuuacagacaagagccuugcuc

SEQ ID NO: 1340 - RNA, 22 nt, Artificial Sequence
  Synthetic Construct
uggucuaggauuguuggaggag

SEQ ID NO: 1341 - RNA, 23 nt, Artificial Sequence
  Synthetic Construct
gacacgggcgacagcugcggccc

SEQ ID NO: 1342 - RNA, 22 nt, Artificial Sequence
  Synthetic Construct
cacacacugcaauuacuuuugc

SEQ ID NO: 1343 - RNA, 19 nt, Artificial Sequence
  Synthetic Construct
aggcugcggaauucaggac

SEQ ID NO: 1344 - RNA, 22 nt, Artificial Sequence
  Synthetic Construct
agaaggcacuaugagauuuaga

SEQ ID NO: 1345 - RNA, 21 nt, Artificial Sequence
  Synthetic Construct
aaacuacugaaaaucaaagau

SEQ ID NO: 1346 - RNA, 21 nt, Artificial Sequence
  Synthetic Construct
ccugcgagucuccggcggugg

SEQ ID NO: 1347 - RNA, 21 nt, Artificial Sequence
  Synthetic Construct
gggcuagggccugcugccccc

SEQ ID NO: 1348 - RNA, 21 nt, Artificial Sequence
  Synthetic Construct
guucaaauccagaucuauaac

SEQ ID NO: 1349 - RNA, 19 nt, Artificial Sequence
  Synthetic Construct
ccgguuccagucccuggag

SEQ ID NO: 1350 - RNA, 19 nt, Artificial Sequence
  Synthetic Construct
uucugcugccggccaaggc

SEQ ID NO: 1351 - RNA, 22 nt, Artificial Sequence
  Synthetic Construct
uccucaucacacugcaccuuag

SEQ ID NO: 1352 - RNA, 20 nt, Artificial Sequence
  Synthetic Construct
gguagugaguuaucagcuac

SEQ ID NO: 1353 - RNA, 20 nt, Artificial Sequence
  Synthetic Construct
gauauucagaggcuaggugg

SEQ ID NO: 1354 - RNA, 21 nt, Artificial Sequence
  Synthetic Construct
acggcccaggcggcauuggug

SEQ ID NO: 1355 - RNA, 21 nt, Artificial Sequence
  Synthetic Construct
agcaugacagaggagaggugg

SEQ ID NO: 1356 - RNA, 21 nt, Artificial Sequence
  Synthetic Construct
gggaagagcuguacggccuuc

SEQ ID NO: 1357 - RNA, 19 nt, Artificial Sequence
  Synthetic Construct
ccgccugagcuagcugugg

SEQ ID NO: 1358 - RNA, 24 nt, Artificial Sequence
  Synthetic Construct
uuggaagcuuggaccaacuagcug

SEQ ID NO: 1359 - RNA, 25 nt, Artificial Sequence
  Synthetic Construct
aggggugguguugggacagcuccgu

SEQ ID NO: 1360 - RNA, 19 nt, Artificial Sequence
  Synthetic Construct
ucuagugcgggcguucccg

SEQ ID NO: 1361 - RNA, 24 nt, Artificial Sequence
  Synthetic Construct
aggagcagugccggccaaggcgcc

SEQ ID NO: 1362 - RNA, 19 nt, Artificial Sequence
  Synthetic Construct
gaauacgucugguugaucc

SEQ ID NO: 1363 - RNA, 20 nt, Artificial Sequence
  Synthetic Construct
cuuauaucagaggcuguggg

SEQ ID NO: 1364 - RNA, 20 nt, Artificial Sequence
  Synthetic Construct
uuccgccagucgguggccgg

SEQ ID NO: 1365 - RNA, 19 nt, Artificial Sequence
  Synthetic Construct
aaggggcugggggagcaca

SEQ ID NO: 1366 - RNA, 20 nt, Artificial Sequence
  Synthetic Construct
ggagguugggaagggcagag

SEQ ID NO: 1367 - RNA, 18 nt, Artificial Sequence
  Synthetic Construct
ugaggcgggggggcgagc

SEQ ID NO: 1368 - RNA, 20 nt, Artificial Sequence
  Synthetic Construct
agagaugaagcgggggggcg

SEQ ID NO: 1369 - RNA, 24 nt, Artificial Sequence
  Synthetic Construct
ggaggccgggguggggcggggcgg

SEQ ID NO: 1370 - RNA, 20 nt, Artificial Sequence
  Synthetic Construct
aggguguuucucucaucucu

SEQ ID NO: 1371 - RNA, 19 nt, Artificial Sequence
  Synthetic Construct
ggggagcgaggggcggggc

SEQ ID NO: 1372 - RNA, 21 nt, Artificial Sequence
  Synthetic Construct
ugagcuaaaugugugcuggga

SEQ ID NO: 1373 - RNA, 23 nt, Artificial Sequence
  Synthetic Construct
gcgaggaccccucggggucugac

SEQ ID NO: 1374 - RNA, 25 nt, Artificial Sequence
  Synthetic Construct
gcugggcagggcuucugagcuccuu

SEQ ID NO: 1375 - RNA, 20 nt, Artificial Sequence
  Synthetic Construct
gggaaaaggaagggggagga

SEQ ID NO: 1376 - RNA, 20 nt, Artificial Sequence
  Synthetic Construct
gcggaaggcggagcggcgga

SEQ ID NO: 1377 - RNA, 18 nt, Artificial Sequence
  Synthetic Construct
gugaaggcccggcggaga

SEQ ID NO: 1378 - RNA, 19 nt, Artificial Sequence
  Synthetic Construct
ugagggagugggugggagg

SEQ ID NO: 1379 - RNA, 19 nt, Artificial Sequence
  Synthetic Construct
acuggaauuggagucaaaa

SEQ ID NO: 1380 - RNA, 19 nt, Artificial Sequence
  Synthetic Construct
ugagggaguuggguguaua

SEQ ID NO: 1381 - RNA, 20 nt, Artificial Sequence
  Synthetic Construct
aggaauguuccuucuuugcc

SEQ ID NO: 1382 - RNA, 19 nt, Artificial Sequence
  Synthetic Construct
ugagggaguggauuguaug

SEQ ID NO: 1383 - RNA, 19 nt, Artificial Sequence
  Synthetic Construct
ggcuggucagaugggagug

SEQ ID NO: 1384 - RNA, 19 nt, Artificial Sequence
  Synthetic Construct
agcagggcuggggauugca

SEQ ID NO: 1385 - RNA, 19 nt, Artificial Sequence
  Synthetic Construct
ugagggaggagguugggua

SEQ ID NO: 1386 - RNA, 19 nt, Artificial Sequence
  Synthetic Construct
ugaggugguaggauguaga

SEQ ID NO: 1387 - RNA, 23 nt, Artificial Sequence
  Synthetic Construct
gaacgccuguucuugccaggugg

SEQ ID NO: 1388 - RNA, 22 nt, Artificial Sequence
  Synthetic Construct
ggggguccccggugcucggauc

SEQ ID NO: 1389 - RNA, 22 nt, Artificial Sequence
  Synthetic Construct
acucaaaacccuucagugacuu

SEQ ID NO: 1390 - RNA, 19 nt, Artificial Sequence
  Synthetic Construct
cagcaggaggugaggggag

SEQ ID NO: 1391 - RNA, 22 nt, Artificial Sequence
  Synthetic Construct
agacuucccauuugaagguggc

SEQ ID NO: 1392 - RNA, 23 nt, Artificial Sequence
  Synthetic Construct
aaacucuacuuguccuucugagu

SEQ ID NO: 1393 - RNA, 22 nt, Artificial Sequence
  Synthetic Construct
gcugggauuacaggcaugagcc

SEQ ID NO: 1394 - RNA, 20 nt, Artificial Sequence
  Synthetic Construct
auggagauagauauagaaau

SEQ ID NO: 1395 - RNA, 21 nt, Artificial Sequence
  Synthetic Construct
ggcuagcaacagcgcuuaccu

SEQ ID NO: 1396 - RNA, 21 nt, Artificial Sequence
  Synthetic Construct
acagucugcugagguuggagc

SEQ ID NO: 1397 - RNA, 23 nt, Artificial Sequence
  Synthetic Construct
aucccuugcaggggcuguugggu

SEQ ID NO: 1398 - RNA, 22 nt, Artificial Sequence
  Synthetic Construct
uaguaccaguaccuuguguuca

SEQ ID NO: 1399 - RNA, 21 nt, Artificial Sequence
  Synthetic Construct
agggggaaaguucuauagucc

SEQ ID NO: 1400 - RNA, 19 nt, Artificial Sequence
  Synthetic Construct
agcugucugaaaaugucuu

SEQ ID NO: 1401 - RNA, 20 nt, Artificial Sequence
  Synthetic Construct
ucuuuucuuugagacucacu

SEQ ID NO: 1402 - RNA, 21 nt, Artificial Sequence
  Synthetic Construct
ucuaguaagaguggcagucga

SEQ ID NO: 1403 - RNA, 21 nt, Artificial Sequence
  Synthetic Construct
uggguuuacguugggagaacu

SEQ ID NO: 1404 - RNA, 22 nt, Artificial Sequence
  Synthetic Construct
aguauucuguaccagggaaggu

SEQ ID NO: 1405 - RNA, 21 nt, Artificial Sequence
  Synthetic Construct
agaccuggcccagaccucagc

SEQ ID NO: 1406 - RNA, 19 nt, Artificial Sequence
  Synthetic Construct
gugucugcuuccuguggga

SEQ ID NO: 1407 - RNA, 23 nt, Artificial Sequence
  Synthetic Construct
cuaauaguaucuaccacaauaaa

SEQ ID NO: 1408 - RNA, 22 nt, Artificial Sequence
  Synthetic Construct
aaccagcaccccaacuuuggac

SEQ ID NO: 1409 - RNA, 23 nt, Artificial Sequence
  Synthetic Construct
acuugggcacugaaacaaugucc

SEQ ID NO: 1410 - RNA, 23 nt, Artificial Sequence
  Synthetic Construct
ugugcuugcucgucccgcccgca

SEQ ID NO: 1411 - RNA, 24 nt, Artificial Sequence
  Synthetic Construct
acugggggcuuucgggcucugcgu

SEQ ID NO: 1412 - RNA, 25 nt, Artificial Sequence
  Synthetic Construct
agggaucgcgggcggguggcggccu

SEQ ID NO: 1413 - RNA, 23 nt, Artificial Sequence
  Synthetic Construct
aucgcugcgguugcgagcgcugu

SEQ ID NO: 1414 - RNA, 21 nt, Artificial Sequence
  Synthetic Construct
augauccaggaaccugccucu

SEQ ID NO: 1415 - RNA, 24 nt, Artificial Sequence
  Synthetic Construct
aaagacauaggauagagucaccuc

SEQ ID NO: 1416 - RNA, 22 nt, Artificial Sequence
  Synthetic Construct
gucccucuccaaaugugucuug

SEQ ID NO: 1417 - RNA, 22 nt, Artificial Sequence
  Synthetic Construct
gguucccucuccaaaugugucu

SEQ ID NO: 1418 - RNA, 22 nt, Artificial Sequence
  Synthetic Construct
acuuguaugcuagcucagguag

SEQ ID NO: 1419 - RNA, 19 nt, Artificial Sequence
  Synthetic Construct
aguguggcuuucuuagagc

SEQ ID NO: 1420 - RNA, 19 nt, Artificial Sequence
  Synthetic Construct
ucuaggcugguacugcuga

SEQ ID NO: 1421 - RNA, 19 nt, Artificial Sequence
  Synthetic Construct
aagcagcugccucugaggc

SEQ ID NO: 1422 - RNA, 21 nt, Artificial Sequence
  Synthetic Construct
guggcugcacucacuuccuuc

SEQ ID NO: 1423 - RNA, 19 nt, Artificial Sequence
  Synthetic Construct
aagugugcagggcacuggu

SEQ ID NO: 1424 - RNA, 22 nt, Artificial Sequence
  Synthetic Construct
aaaccuguguuguucaagaguc

SEQ ID NO: 1425 - RNA, 22 nt, Artificial Sequence
  Synthetic Construct
agcaguguuuguuuugcccaca

SEQ ID NO: 1426 - RNA, 21 nt, Artificial Sequence
  Synthetic Construct
aggaggcagcgcucucaggac

SEQ ID NO: 1427 - RNA, 21 nt, Artificial Sequence
  Synthetic Construct
acacuuguugggaugaccugc

SEQ ID NO: 1428 - RNA, 23 nt, Artificial Sequence
  Synthetic Construct
ccagagcagccugcgguaacagu

SEQ ID NO: 1429 - RNA, 22 nt, Artificial Sequence
  Synthetic Construct
agcucuagaaagauuguugacc

SEQ ID NO: 1430 - RNA, 21 nt, Artificial Sequence
  Synthetic Construct
gggacuaggaugcagaccucc

SEQ ID NO: 1431 - RNA, 20 nt, Artificial Sequence
  Synthetic Construct
cauuacagcacagccauucu

SEQ ID NO: 1432 - RNA, 21 nt, Artificial Sequence
  Synthetic Construct
ugacuucuaccucuuccaaag

SEQ ID NO: 1433 - RNA, 23 nt, Artificial Sequence
  Synthetic Construct
acugggaugucacugaauauggu

SEQ ID NO: 1434 - RNA, 22 nt, Artificial Sequence
  Synthetic Construct
caaaguccuuccuauuuuuccc

SEQ ID NO: 1435 - RNA, 21 nt, Artificial Sequence
  Synthetic Construct
ucuagaaaugcaugacccacc

SEQ ID NO: 1436 - RNA, 21 nt, Artificial Sequence
  Synthetic Construct
auuagguaguggcaguggaac

SEQ ID NO: 1437 - RNA, 22 nt, Artificial Sequence
  Synthetic Construct
uuuaggauaagcuugacuuuug

SEQ ID NO: 1438 - RNA, 22 nt, Artificial Sequence
  Synthetic Construct
cagcaggggagagagaggaguc

SEQ ID NO: 1439 - RNA, 23 nt, Artificial Sequence
  Synthetic Construct
caggcagaaguggggcugacagg

SEQ ID NO: 1440 - RNA, 24 nt, Artificial Sequence
  Synthetic Construct
cugcaggcagaaguggggcugaca

SEQ ID NO: 1441 - RNA, 22 nt, Artificial Sequence
  Synthetic Construct
uaccauuagaagagcuggaaga

SEQ ID NO: 1442 - RNA, 23 nt, Artificial Sequence
  Synthetic Construct
uuugggauugacgccacaugucu

SEQ ID NO: 1443 - RNA, 21 nt, Artificial Sequence
  Synthetic Construct
cugccuguucuuccacuccag

SEQ ID NO: 1444 - RNA, 20 nt, Artificial Sequence
  Synthetic Construct
ucucuucaucuaccccccag

SEQ ID NO: 1445 - RNA, 22 nt, Artificial Sequence
  Synthetic Construct
uuugcaguaacaggugugagca

SEQ ID NO: 1446 - RNA, 21 nt, Artificial Sequence
  Synthetic Construct
aauggcgccacuaggguugug

SEQ ID NO: 1447 - RNA, 21 nt, Artificial Sequence
  Synthetic Construct
guguugaaacaaucucuacug

SEQ ID NO: 1448 - RNA, 22 nt, Artificial Sequence
  Synthetic Construct
uggugggccgcagaacaugugc

SEQ ID NO: 1449 - RNA, 22 nt, Artificial Sequence
  Synthetic Construct
agagguuauccguguuauguuc

SEQ ID NO: 1450 - RNA, 21 nt, Artificial Sequence
  Synthetic Construct
agguugccugugagguguuca

SEQ ID NO: 1451 - RNA, 23 nt, Artificial Sequence
  Synthetic Construct
ggcagguucucacccucucuagg

SEQ ID NO: 1452 - RNA, 25 nt, Artificial Sequence
  Synthetic Construct
ggcggagggaaguagguccguuggu

SEQ ID NO: 1453 - RNA, 22 nt, Artificial Sequence
  Synthetic Construct
aggaccuucccugaaccaagga

SEQ ID NO: 1454 - RNA, 21 nt, Artificial Sequence
  Synthetic Construct
accuccugugugcauggauua

SEQ ID NO: 1455 - RNA, 24 nt, Artificial Sequence
  Synthetic Construct
ugccugggucucuggccugcgcgu

SEQ ID NO: 1456 - RNA, 21 nt, Artificial Sequence
  Synthetic Construct
ucccacguuguggcccagcag

SEQ ID NO: 1457 - RNA, 22 nt, Artificial Sequence
  Synthetic Construct
aggcggggcgccgcgggaccgc

SEQ ID NO: 1458 - RNA, 22 nt, Artificial Sequence
  Synthetic Construct
gguggcccggccgugccugagg

SEQ ID NO: 1459 - RNA, 24 nt, Artificial Sequence
  Synthetic Construct
acuggcuagggaaaaugauuggau

SEQ ID NO: 1460 - RNA, 22 nt, Artificial Sequence
  Synthetic Construct
uucauuugccucccagccuaca

SEQ ID NO: 1461 - RNA, 20 nt, Artificial Sequence
  Synthetic Construct
accaggaggcugaggccccu

SEQ ID NO: 1462 - RNA, 23 nt, Artificial Sequence
  Synthetic Construct
ugucacucggcucggcccacuac

SEQ ID NO: 1463 - RNA, 21 nt, Artificial Sequence
  Synthetic Construct
uuuccucauauucauucagga

SEQ ID NO: 1464 - RNA, 21 nt, Artificial Sequence
  Synthetic Construct
uccgguucucagggcuccacc

SEQ ID NO: 1465 - RNA, 21 nt, Artificial Sequence
  Synthetic Construct
ccaaaccagucgugccugugg

SEQ ID NO: 1466 - RNA, 22 nt, Artificial Sequence
  Synthetic Construct
cucaaaccggcugugccugugg

SEQ ID NO: 1467 - RNA, 20 nt, Artificial Sequence
  Synthetic Construct
ugggaauggggguaagggcc

SEQ ID NO: 1468 - RNA, 22 nt, Artificial Sequence
  Synthetic Construct
aggcgauguggggauguagaga

SEQ ID NO: 1469 - RNA, 21 nt, Artificial Sequence
  Synthetic Construct
uaguggucagagggcuuauga

SEQ ID NO: 1470 - RNA, 22 nt, Artificial Sequence
  Synthetic Construct
ucugacaucagugauucuccug

SEQ ID NO: 1471 - RNA, 23 nt, Artificial Sequence
  Synthetic Construct
uuccagcccugguaggcgccgcg

SEQ ID NO: 1472 - RNA, 23 nt, Artificial Sequence
  Synthetic Construct
ugggcaggggcuuauuguaggag

SEQ ID NO: 1473 - RNA, 22 nt, Artificial Sequence
  Synthetic Construct
ugcaggggucgggugggccagg

SEQ ID NO: 1474 - RNA, 22 nt, Artificial Sequence
  Synthetic Construct
auaguccgaguaacgucggggc

SEQ ID NO: 1475 - RNA, 23 nt, Artificial Sequence
  Synthetic Construct
cugggcccgcggcgggcgugggg

SEQ ID NO: 1476 - RNA, 21 nt, Artificial Sequence
  Synthetic Construct
cgggagcuggggucugcaggu

SEQ ID NO: 1477 - RNA, 20 nt, Artificial Sequence
  Synthetic Construct
uccugccaccuccuccgcag

SEQ ID NO: 1478 - RNA, 21 nt, Artificial Sequence
  Synthetic Construct
ucucugcucugcucuccccag

SEQ ID NO: 1479 - RNA, 21 nt, Artificial Sequence
  Synthetic Construct
ucaucccccucgcccucucag

SEQ ID NO: 1480 - RNA, 23 nt, Artificial Sequence
  Synthetic Construct
agaaagguggagggguugucaga

SEQ ID NO: 1481 - RNA, 22 nt, Artificial Sequence
  Synthetic Construct
ugggagagcaggguauugugga

SEQ ID NO: 1482 - RNA, 20 nt, Artificial Sequence
  Synthetic Construct
uaggggguggcaggcuggcc

SEQ ID NO: 1483 - RNA, 20 nt, Artificial Sequence
  Synthetic Construct
ucagugucuggauuuccuag

SEQ ID NO: 1484 - RNA, 23 nt, Artificial Sequence
  Synthetic Construct
cccuucccucacucuucucucag

SEQ ID NO: 1485 - RNA, 22 nt, Artificial Sequence
  Synthetic Construct
aggccuguggcuccucccucag

SEQ ID NO: 1486 - RNA, 21 nt, Artificial Sequence
  Synthetic Construct
ucagcuccucucuacccacag

SEQ ID NO: 1487 - RNA, 21 nt, Artificial Sequence
  Synthetic Construct
uugggguggucggcccuggag

SEQ ID NO: 1488 - RNA, 24 nt, Artificial Sequence
  Synthetic Construct
cuucugccugcauucuacucccag

SEQ ID NO: 1489 - RNA, 21 nt, Artificial Sequence
  Synthetic Construct
auuguucugucuuucucccag

SEQ ID NO: 1490 - RNA, 22 nt, Artificial Sequence
  Synthetic Construct
ugucuucucuccucccaaacag

SEQ ID NO: 1491 - RNA, 22 nt, Artificial Sequence
  Synthetic Construct
ucggcucucucccucacccuag

SEQ ID NO: 1492 - RNA, 22 nt, Artificial Sequence
  Synthetic Construct
aguggggugggacccagcuguu

SEQ ID NO: 1493 - RNA, 22 nt, Artificial Sequence
  Synthetic Construct
aaggggcagggacggguggccc

SEQ ID NO: 1494 - RNA, 23 nt, Artificial Sequence
  Synthetic Construct
gggccucucuugucauccugcag

SEQ ID NO: 1495 - RNA, 21 nt, Artificial Sequence
  Synthetic Construct
uggguggaagaaggucugguu

SEQ ID NO: 1496 - RNA, 22 nt, Artificial Sequence
  Synthetic Construct
ccgggagaaggagguggccugg

SEQ ID NO: 1497 - RNA, 21 nt, Artificial Sequence
  Synthetic Construct
uccugccuuccucugcaccag

SEQ ID NO: 1498 - RNA, 21 nt, Artificial Sequence
  Synthetic Construct
uccugucccugucuccuacag

SEQ ID NO: 1499 - RNA, 22 nt, Artificial Sequence
  Synthetic Construct
ucgggccugggguugggggagc

SEQ ID NO: 1500 - RNA, 23 nt, Artificial Sequence
  Synthetic Construct
uggugcggagagggcccacagug

SEQ ID NO: 1501 - RNA, 24 nt, Artificial Sequence
  Synthetic Construct
cagggaacagcugggugagcugcu

SEQ ID NO: 1502 - RNA, 23 nt, Artificial Sequence
  Synthetic Construct
uugggggugagguuggugucugg

SEQ ID NO: 1503 - RNA, 21 nt, Artificial Sequence
  Synthetic Construct
ucccugcccccauacucccag

SEQ ID NO: 1504 - RNA, 22 nt, Artificial Sequence
  Synthetic Construct
uggucugucucugcccuggcac

SEQ ID NO: 1505 - RNA, 22 nt, Artificial Sequence
  Synthetic Construct
ucuucaccugccucugccugca

SEQ ID NO: 1506 - RNA, 22 nt, Artificial Sequence
  Synthetic Construct
uguugucauguuuuuucccuag

SEQ ID NO: 1507 - RNA, 20 nt, Artificial Sequence
  Synthetic Construct
uccccuuccucccugcccag

SEQ ID NO: 1508 - RNA, 22 nt, Artificial Sequence
  Synthetic Construct
uagggaugggaggccaggauga

SEQ ID NO: 1509 - RNA, 20 nt, Artificial Sequence
  Synthetic Construct
acucauucuccucuguccag

SEQ ID NO: 1510 - RNA, 22 nt, Artificial Sequence
  Synthetic Construct
uugugggugggcagaagucugu

SEQ ID NO: 1511 - RNA, 21 nt, Artificial Sequence
  Synthetic Construct
cuguccuaagguuguugaguu

SEQ ID NO: 1512 - RNA, 23 nt, Artificial Sequence
  Synthetic Construct
cagggagaagguggaagugcaga

SEQ ID NO: 1513 - RNA, 21 nt, Artificial Sequence
  Synthetic Construct
ucugagagagcucgauggcag

SEQ ID NO: 1514 - RNA, 23 nt, Artificial Sequence
  Synthetic Construct
cggggccauggagcagccugugu

SEQ ID NO: 1515 - RNA, 19 nt, Artificial Sequence
  Synthetic Construct
cuggggaguggcuggggag

SEQ ID NO: 1516 - RNA, 21 nt, Artificial Sequence
  Synthetic Construct
ucucuggucuuuccuugacag

SEQ ID NO: 1517 - RNA, 21 nt, Artificial Sequence
  Synthetic Construct
ucaccuggcuggcccgcccag

SEQ ID NO: 1518 - RNA, 24 nt, Artificial Sequence
  Synthetic Construct
cgggugggagcagaucuuauugag

SEQ ID NO: 1519 - RNA, 23 nt, Artificial Sequence
  Synthetic Construct
ucgcagacagggacacauggaga

SEQ ID NO: 1520 - RNA, 24 nt, Artificial Sequence
  Synthetic Construct
caaaggccacauucuccugugcac

SEQ ID NO: 1521 - RNA, 21 nt, Artificial Sequence
  Synthetic Construct
gagccccucucugcucuccag

SEQ ID NO: 1522 - RNA, 23 nt, Artificial Sequence
  Synthetic Construct
ugguggguggggaggagaagugc

SEQ ID NO: 1523 - RNA, 24 nt, Artificial Sequence
  Synthetic Construct
ugagaaggcacagcuugcacguga

SEQ ID NO: 1524 - RNA, 22 nt, Artificial Sequence
  Synthetic Construct
cucgggagggcaugggccaggc

SEQ ID NO: 1525 - RNA, 22 nt, Artificial Sequence
  Synthetic Construct
uggguguaggcuggagcugagg

SEQ ID NO: 1526 - RNA, 22 nt, Artificial Sequence
  Synthetic Construct
acugucacuucucugcccauag

SEQ ID NO: 1527 - RNA, 25 nt, Artificial Sequence
  Synthetic Construct
acuugggcaggagggacccuguaug

SEQ ID NO: 1528 - RNA, 21 nt, Artificial Sequence
  Synthetic Construct
aggcccuguccucugccccag

SEQ ID NO: 1529 - RNA, 19 nt, Artificial Sequence
  Synthetic Construct
ucugggugcaguggggguu

SEQ ID NO: 1530 - RNA, 20 nt, Artificial Sequence
  Synthetic Construct
uccacucuccuggcccccag

SEQ ID NO: 1531 - RNA, 21 nt, Artificial Sequence
  Synthetic Construct
ugccucccugacauuccacag

SEQ ID NO: 1532 - RNA, 21 nt, Artificial Sequence
  Synthetic Construct
aagcccugucuccucccaucu

SEQ ID NO: 1533 - RNA, 21 nt, Artificial Sequence
  Synthetic Construct
cuccucuguuuucuuuccuag

SEQ ID NO: 1534 - RNA, 21 nt, Artificial Sequence
  Synthetic Construct
ucccuugucuccuuucccuag

SEQ ID NO: 1535 - RNA, 21 nt, Artificial Sequence
  Synthetic Construct
cgggccggaggucaagggcgu

SEQ ID NO: 1536 - RNA, 25 nt, Artificial Sequence
  Synthetic Construct
uaggggugggggaauucaggggugu

SEQ ID NO: 1537 - RNA, 22 nt, Artificial Sequence
  Synthetic Construct
uuccugggcuucuccucuguag

SEQ ID NO: 1538 - RNA, 22 nt, Artificial Sequence
  Synthetic Construct
ucucaccccaacucugccccag

SEQ ID NO: 1539 - RNA, 21 nt, Artificial Sequence
  Synthetic Construct
acaucgccccaccuuccccag

SEQ ID NO: 1540 - RNA, 23 nt, Artificial Sequence
  Synthetic Construct
ugacgccccuucugauucugccu

SEQ ID NO: 1541 - RNA, 22 nt, Artificial Sequence
  Synthetic Construct
ucucagcugcugcccucuccag

SEQ ID NO: 1542 - RNA, 21 nt, Artificial Sequence
  Synthetic Construct
cugggagaagaguggugaaga

SEQ ID NO: 1543 - RNA, 21 nt, Artificial Sequence
  Synthetic Construct
cggcgcccgugucuccuccag

SEQ ID NO: 1544 - RNA, 23 nt, Artificial Sequence
  Synthetic Construct
gugaguguggauuuggcgggguu

SEQ ID NO: 1545 - RNA, 22 nt, Artificial Sequence
  Synthetic Construct
ccccuggggcugggcaggcgga

SEQ ID NO: 1546 - RNA, 22 nt, Artificial Sequence
  Synthetic Construct
cuccuccacagccccugcucau

SEQ ID NO: 1547 - RNA, 22 nt, Artificial Sequence
  Synthetic Construct
uguggguucuggguugggguga

SEQ ID NO: 1548 - RNA, 20 nt, Artificial Sequence
  Synthetic Construct
cagggggacugggggugagc

SEQ ID NO: 1549 - RNA, 24 nt, Artificial Sequence
  Synthetic Construct
uggggggacaggaugagaggcugu

SEQ ID NO: 1550 - RNA, 21 nt, Artificial Sequence
  Synthetic Construct
gaagcucuccccuccccgcag

SEQ ID NO: 1551 - RNA, 22 nt, Artificial Sequence
  Synthetic Construct
ugcaugacccuucccuccccac

SEQ ID NO: 1552 - RNA, 23 nt, Artificial Sequence
  Synthetic Construct
ccagggggaugggcgagcuuggg

SEQ ID NO: 1553 - RNA, 20 nt, Artificial Sequence
  Synthetic Construct
ggggaggugugcagggcugg

SEQ ID NO: 1554 - RNA, 21 nt, Artificial Sequence
  Synthetic Construct
guaggugacagucaggggcgg

SEQ ID NO: 1555 - RNA, 23 nt, Artificial Sequence
  Synthetic Construct
uggucagaggcagcaggaaauga

SEQ ID NO: 1556 - RNA, 22 nt, Artificial Sequence
  Synthetic Construct
uucaccccucucaccuaagcag

SEQ ID NO: 1557 - RNA, 22 nt, Artificial Sequence
  Synthetic Construct
ucccucgccuucucacccucag

SEQ ID NO: 1558 - RNA, 21 nt, Artificial Sequence
  Synthetic Construct
ugagggugucagcaggugacg

SEQ ID NO: 1559 - RNA, 23 nt, Artificial Sequence
  Synthetic Construct
uugcucugcucccccgcccccag

SEQ ID NO: 1560 - RNA, 22 nt, Artificial Sequence
  Synthetic Construct
ugaagcucugacauuccugcag

SEQ ID NO: 1561 - RNA, 22 nt, Artificial Sequence
  Synthetic Construct
gugagccaguggaauggagagg

SEQ ID NO: 1562 - RNA, 22 nt, Artificial Sequence
  Synthetic Construct
caggcagggaggugggaccaug

SEQ ID NO: 1563 - RNA, 21 nt, Artificial Sequence
  Synthetic Construct
cuucucuucucuccuucccag

SEQ ID NO: 1564 - RNA, 23 nt, Artificial Sequence
  Synthetic Construct
auggggacagggaucagcauggc

SEQ ID NO: 1565 - RNA, 21 nt, Artificial Sequence
  Synthetic Construct
agccugugcuugucccugcag

SEQ ID NO: 1566 - RNA, 25 nt, Artificial Sequence
  Synthetic Construct
auggggugagauggggaggagcagc

SEQ ID NO: 1567 - RNA, 23 nt, Artificial Sequence
  Synthetic Construct
caggggcugggguuucagguucu

SEQ ID NO: 1568 - RNA, 22 nt, Artificial Sequence
  Synthetic Construct
acucgcauccuucccuuggcag

SEQ ID NO: 1569 - RNA, 23 nt, Artificial Sequence
  Synthetic Construct
uagguggcgccggaggagucauu

SEQ ID NO: 1570 - RNA, 21 nt, Artificial Sequence
  Synthetic Construct
uggggcggggcaggucccugc

SEQ ID NO: 1571 - RNA, 24 nt, Artificial Sequence
  Synthetic Construct
ucugccauaggaagcuuggagugg

SEQ ID NO: 1572 - RNA, 22 nt, Artificial Sequence
  Synthetic Construct
uugugugaguacagagagcauc

SEQ ID NO: 1573 - RNA, 22 nt, Artificial Sequence
  Synthetic Construct
uugggguggagggccaaggagc

SEQ ID NO: 1574 - RNA, 19 nt, Artificial Sequence
  Synthetic Construct
ugcggcagagcugggguca

SEQ ID NO: 1575 - RNA, 23 nt, Artificial Sequence
  Synthetic Construct
gugcgugguggcucgaggcgggg

SEQ ID NO: 1576 - RNA, 24 nt, Artificial Sequence
  Synthetic Construct
aggcucuaacuggcuuucccugca

SEQ ID NO: 1577 - RNA, 21 nt, Artificial Sequence
  Synthetic Construct
ucaggguugguagggguugcu

SEQ ID NO: 1578 - RNA, 22 nt, Artificial Sequence
  Synthetic Construct
guaggggagguugggccaggga

SEQ ID NO: 1579 - RNA, 22 nt, Artificial Sequence
  Synthetic Construct
gcgcugacccgccuucuccgca

SEQ ID NO: 1580 - RNA, 22 nt, Artificial Sequence
  Synthetic Construct
cuccccucucuuuccuguucag

SEQ ID NO: 1581 - RNA, 22 nt, Artificial Sequence
  Synthetic Construct
ugggagccaugagggucugugc

SEQ ID NO: 1582 - RNA, 20 nt, Artificial Sequence
  Synthetic Construct
aucugcucucuuguucccag

SEQ ID NO: 1583 - RNA, 20 nt, Artificial Sequence
  Synthetic Construct
ugggcugcugagaaggggca

SEQ ID NO: 1584 - RNA, 22 nt, Artificial Sequence
  Synthetic Construct
ccaaggaaggaggcuggacauc

SEQ ID NO: 1585 - RNA, 24 nt, Artificial Sequence
  Synthetic Construct
uagguagagugugaggaggagguc

SEQ ID NO: 1586 - RNA, 23 nt, Artificial Sequence
  Synthetic Construct
aguagagaggaaaaguuaggguc

SEQ ID NO: 1587 - RNA, 21 nt, Artificial Sequence
  Synthetic Construct
uuucucucuccacuuccucag

SEQ ID NO: 1588 - RNA, 21 nt, Artificial Sequence
  Synthetic Construct
gugagggacugggauuugugg

SEQ ID NO: 1589 - RNA, 22 nt, Artificial Sequence
  Synthetic Construct
aggggguagaaaguggcugaag

SEQ ID NO: 1590 - RNA, 21 nt, Artificial Sequence
  Synthetic Construct
augccucccccggccccgcag

SEQ ID NO: 1591 - RNA, 21 nt, Artificial Sequence
  Synthetic Construct
accagggccagcagggaaugu

SEQ ID NO: 1592 - RNA, 22 nt, Artificial Sequence
  Synthetic Construct
aagcagcaguggcaagacuccu

SEQ ID NO: 1593 - RNA, 22 nt, Artificial Sequence
  Synthetic Construct
ucuggauugaagagacgaccca

SEQ ID NO: 1594 - RNA, 24 nt, Artificial Sequence
  Synthetic Construct
acccccgggcaaagaccugcagau

SEQ ID NO: 1595 - RNA, 22 nt, Artificial Sequence
  Synthetic Construct
uaggguacucagagcaaguugu

SEQ ID NO: 1596 - RNA, 22 nt, Artificial Sequence
  Synthetic Construct
uggggguggucucuagccaagg

SEQ ID NO: 1597 - RNA, 21 nt, Artificial Sequence
  Synthetic Construct
auggucuccuguucucugcag

SEQ ID NO: 1598 - RNA, 21 nt, Artificial Sequence
  Synthetic Construct
uucuuuguuuuuaauucacag

SEQ ID NO: 1599 - RNA, 19 nt, Artificial Sequence
  Synthetic Construct
cggggccagagcagagagc

SEQ ID NO: 1600 - RNA, 21 nt, Artificial Sequence
  Synthetic Construct
ugaccccuucugucucccuag

SEQ ID NO: 1601 - RNA, 22 nt, Artificial Sequence
  Synthetic Construct
ggcucaugugucuguccucuuc

SEQ ID NO: 1602 - RNA, 23 nt, Artificial Sequence
  Synthetic Construct
ugggggcugggaugggccauggu

SEQ ID NO: 1603 - RNA, 22 nt, Artificial Sequence
  Synthetic Construct
accagccuguguccaccuccag

SEQ ID NO: 1604 - RNA, 20 nt, Artificial Sequence
  Synthetic Construct
cccggccggaacgccgcacu

SEQ ID NO: 1605 - RNA, 23 nt, Artificial Sequence
  Synthetic Construct
aggaggugguacuaggggccagc

SEQ ID NO: 1606 - RNA, 21 nt, Artificial Sequence
  Synthetic Construct
cccugggguucugaggacaug

SEQ ID NO: 1607 - RNA, 24 nt, Artificial Sequence
  Synthetic Construct
agcgugggauguccaugaagucag

SEQ ID NO: 1608 - RNA, 21 nt, Artificial Sequence
  Synthetic Construct
ugcguuucuccucuugagcag

SEQ ID NO: 1609 - RNA, 22 nt, Artificial Sequence
  Synthetic Construct
agacugaccuucaaccccacag

SEQ ID NO: 1610 - RNA, 22 nt, Artificial Sequence
  Synthetic Construct
uacagcccugugaucuuuccag

SEQ ID NO: 1611 - RNA, 21 nt, Artificial Sequence
  Synthetic Construct
ugacugagcuucuccccacag

SEQ ID NO: 1612 - RNA, 22 nt, Artificial Sequence
  Synthetic Construct
cagccagccccugcucaccccu

SEQ ID NO: 1613 - RNA, 23 nt, Artificial Sequence
  Synthetic Construct
ugacccccaugucgccucuguag

SEQ ID NO: 1614 - RNA, 22 nt, Artificial Sequence
  Synthetic Construct
acugggcagggcuguggugagu

SEQ ID NO: 1615 - RNA, 22 nt, Artificial Sequence
  Synthetic Construct
acuggguagguggggcuccagg

SEQ ID NO: 1616 - RNA, 24 nt, Artificial Sequence
  Synthetic Construct
ccucacccagcucucuggcccucu

SEQ ID NO: 1617 - RNA, 23 nt, Artificial Sequence
  Synthetic Construct
uagacguggugaaggauugagug

SEQ ID NO: 1618 - RNA, 24 nt, Artificial Sequence
  Synthetic Construct
uugaagggacaagucagauaugcc

SEQ ID NO: 1619 - RNA, 21 nt, Artificial Sequence
  Synthetic Construct
acacccucuuucccuaccgcc

SEQ ID NO: 1620 - RNA, 22 nt, Artificial Sequence
  Synthetic Construct
gaucccuuuaucuguccucuag

SEQ ID NO: 1621 - RNA, 23 nt, Artificial Sequence
  Synthetic Construct
uguguguguagaggaagaaggga

SEQ ID NO: 1622 - RNA, 22 nt, Artificial Sequence
  Synthetic Construct
acuggcagaacacugaagcagc

SEQ ID NO: 1623 - RNA, 22 nt, Artificial Sequence
  Synthetic Construct
gugaguaguggcgcgcggcggc

SEQ ID NO: 1624 - RNA, 19 nt, Artificial Sequence
  Synthetic Construct
ugggggagauggggguuga

SEQ ID NO: 1625 - RNA, 22 nt, Artificial Sequence
  Synthetic Construct
caugggaguucggggugguugc

SEQ ID NO: 1626 - RNA, 21 nt, Artificial Sequence
  Synthetic Construct
cccaugccuccugccgcgguc

SEQ ID NO: 1627 - RNA, 23 nt, Artificial Sequence
  Synthetic Construct
uucucucugucuuucucucucag

SEQ ID NO: 1628 - RNA, 23 nt, Artificial Sequence
  Synthetic Construct
auggagcuggaaccagaucaggc

SEQ ID NO: 1629 - RNA, 21 nt, Artificial Sequence
  Synthetic Construct
ugagggacccaggacaggaga

SEQ ID NO: 1630 - RNA, 24 nt, Artificial Sequence
  Synthetic Construct
agcugucuguguuuuccuucucag

SEQ ID NO: 1631 - RNA, 21 nt, Artificial Sequence
  Synthetic Construct
cagccucugcccuuggccucc

SEQ ID NO: 1632 - RNA, 21 nt, Artificial Sequence
  Synthetic Construct
cuggccucuucuuucuccuag

SEQ ID NO: 1633 - RNA, 21 nt, Artificial Sequence
  Synthetic Construct
ugucacccgcuccuugcccag

SEQ ID NO: 1634 - RNA, 22 nt, Artificial Sequence
  Synthetic Construct
ugguggaggaagagggcagcuc

SEQ ID NO: 1635 - RNA, 22 nt, Artificial Sequence
  Synthetic Construct
auccucuuucguccuucccacu

SEQ ID NO: 1636 - RNA, 24 nt, Artificial Sequence
  Synthetic Construct
ugcugccucuccucuugccugcag

SEQ ID NO: 1637 - RNA, 22 nt, Artificial Sequence
  Synthetic Construct
uucccuaucucacucuccucag

SEQ ID NO: 1638 - RNA, 23 nt, Artificial Sequence
  Synthetic Construct
cccaucaccuuuccgucuccccu

SEQ ID NO: 1639 - RNA, 25 nt, Artificial Sequence
  Synthetic Construct
aggggggcacugcgcaagcaaagcc

SEQ ID NO: 1640 - RNA, 21 nt, Artificial Sequence
  Synthetic Construct
ugcccuucucuccuccugccu

SEQ ID NO: 1641 - RNA, 21 nt, Artificial Sequence
  Synthetic Construct
uccccuccacuuuccuccuag

SEQ ID NO: 1642 - RNA, 20 nt, Artificial Sequence
  Synthetic Construct
aaggagaugcucaggcagau

SEQ ID NO: 1643 - RNA, 23 nt, Artificial Sequence
  Synthetic Construct
ucggggagucugggguccggaau

SEQ ID NO: 1644 - RNA, 20 nt, Artificial Sequence
  Synthetic Construct
ccacugccuaugccccacag

SEQ ID NO: 1645 - RNA, 21 nt, Artificial Sequence
  Synthetic Construct
cccucaucuuccccuccuuuc

SEQ ID NO: 1646 - RNA, 21 nt, Artificial Sequence
  Synthetic Construct
guaagggaccggagaguagga

SEQ ID NO: 1647 - RNA, 22 nt, Artificial Sequence
  Synthetic Construct
cccugcugccuucaccugccag

SEQ ID NO: 1648 - RNA, 21 nt, Artificial Sequence
  Synthetic Construct
uugccugcccucuuccuccag

SEQ ID NO: 1649 - RNA, 21 nt, Artificial Sequence
  Synthetic Construct
cagggccaggcacagaguaag

SEQ ID NO: 1650 - RNA, 23 nt, Artificial Sequence
  Synthetic Construct
uggaagacuagugauuuuguugu

SEQ ID NO: 1651 - RNA, 23 nt, Artificial Sequence
  Synthetic Construct
uggaagacuagugauuuuguugu

SEQ ID NO: 1652 - RNA, 22 nt, Artificial Sequence
  Synthetic Construct
caacuagacugugagcuucuag

SEQ ID NO: 1653 - RNA, 20 nt, Artificial Sequence
  Synthetic Construct
ugggaggaggggaucuuggg

SEQ ID NO: 1654 - RNA, 22 nt, Artificial Sequence
  Synthetic Construct
ucggccuggggaggaggaaggg

SEQ ID NO: 1655 - RNA, 21 nt, Artificial Sequence
  Synthetic Construct
guguggccggcaggcgggugg

SEQ ID NO: 1656 - RNA, 22 nt, Artificial Sequence
  Synthetic Construct
caagccucuccugcccuuccag

SEQ ID NO: 1657 - RNA, 22 nt, Artificial Sequence
  Synthetic Construct
gggacccagggagagacguaag

SEQ ID NO: 1658 - RNA, 22 nt, Artificial Sequence
  Synthetic Construct
ucucucucccacuucccugcag

SEQ ID NO: 1659 - RNA, 22 nt, Artificial Sequence
  Synthetic Construct
auccucucuucccuccucccag

SEQ ID NO: 1660 - RNA, 23 nt, Artificial Sequence
  Synthetic Construct
ugcaucacagccuuuggcccuag

SEQ ID NO: 1661 - RNA, 21 nt, Artificial Sequence
  Synthetic Construct
uccagggagacagugugugag

SEQ ID NO: 1662 - RNA, 21 nt, Artificial Sequence
  Synthetic Construct
ugacccaccccucuccaccag

SEQ ID NO: 1663 - RNA, 18 nt, Artificial Sequence
  Synthetic Construct
cuggcagggggagaggua

SEQ ID NO: 1664 - RNA, 23 nt, Artificial Sequence
  Synthetic Construct
gauccaucucugccuguauuggc

SEQ ID NO: 1665 - RNA, 20 nt, Artificial Sequence
  Synthetic Construct
ucugguccuggacaggaggc

SEQ ID NO: 1666 - RNA, 18 nt, Artificial Sequence
  Synthetic Construct
caccauggacgguuuacc

SEQ ID NO: 1667 - RNA, 23 nt, Artificial Sequence
  Synthetic Construct
uucaugaacugggucuagcuugg

SEQ ID NO: 1668 - RNA, 19 nt, Artificial Sequence
  Synthetic Construct
uggcccaagaccucagacc

SEQ ID NO: 1669 - RNA, 23 nt, Artificial Sequence
  Synthetic Construct
cugcagccacuuggggaacuggu

SEQ ID NO: 1670 - RNA, 22 nt, Artificial Sequence
  Synthetic Construct
ucugugcuacuggaugaagagu

SEQ ID NO: 1671 - RNA, 24 nt, Artificial Sequence
  Synthetic Construct
ggcucaaucucugguccugcagcc

SEQ ID NO: 1672 - RNA, 19 nt, Artificial Sequence
  Synthetic Construct
uuucuauguuaguuggaag

SEQ ID NO: 1673 - RNA, 21 nt, Artificial Sequence
  Synthetic Construct
cagggcccuggcuuuagcaga

SEQ ID NO: 1674 - RNA, 23 nt, Artificial Sequence
  Synthetic Construct
uaaagacuguagaggcaacuggu

SEQ ID NO: 1675 - RNA, 19 nt, Artificial Sequence
  Synthetic Construct
ucugagguggaacagcagc

SEQ ID NO: 1676 - RNA, 21 nt, Artificial Sequence
  Synthetic Construct
cuuccgccccgccgggcgucg

SEQ ID NO: 1677 - RNA, 22 nt, Artificial Sequence
  Synthetic Construct
ugcggggcuagggcuaacagca

SEQ ID NO: 1678 - RNA, 18 nt, Artificial Sequence
  Synthetic Construct
agaagggaagauggugac

SEQ ID NO: 1679 - RNA, 22 nt, Artificial Sequence
  Synthetic Construct
uuugugaccugguccacuaacc

SEQ ID NO: 1680 - RNA, 22 nt, Artificial Sequence
  Synthetic Construct
gcagagugcaaacaauuuugac

SEQ ID NO: 1681 - RNA, 20 nt, Artificial Sequence
  Synthetic Construct
cggcucugggucugugggga

SEQ ID NO: 1682 - RNA, 22 nt, Artificial Sequence
  Synthetic Construct
gcagcagggugaaacugacaca

SEQ ID NO: 1683 - RNA, 22 nt, Artificial Sequence
  Synthetic Construct
ggggcuggggccggggccgagc

SEQ ID NO: 1684 - RNA, 22 nt, Artificial Sequence
  Synthetic Construct
gcaggugcucacuuguccuccu

SEQ ID NO: 1685 - RNA, 19 nt, Artificial Sequence
  Synthetic Construct
uugaucucggaagcuaagc

SEQ ID NO: 1686 - RNA, 21 nt, Artificial Sequence
  Synthetic Construct
uggaggagaaggaaggugaug

SEQ ID NO: 1687 - RNA, 22 nt, Artificial Sequence
  Synthetic Construct
aggaggaauuggugcuggucuu

SEQ ID NO: 1688 - RNA, 23 nt, Artificial Sequence
  Synthetic Construct
ugcaccaugguugucugagcaug

SEQ ID NO: 1689 - RNA, 23 nt, Artificial Sequence
  Synthetic Construct
cugggaucuccggggucuugguu

SEQ ID NO: 1690 - RNA, 23 nt, Artificial Sequence
  Synthetic Construct
uccaguaccacgugucagggcca

SEQ ID NO: 1691 - RNA, 22 nt, Artificial Sequence
  Synthetic Construct
cuuagacugccagacucccuga

SEQ ID NO: 1692 - RNA, 23 nt, Artificial Sequence
  Synthetic Construct
uugcacucuggccuucucccagg

SEQ ID NO: 1693 - RNA, 19 nt, Artificial Sequence
  Synthetic Construct
cggggucggcggcgacgug

SEQ ID NO: 1694 - RNA, 23 nt, Artificial Sequence
  Synthetic Construct
aauagcucagaaugucaguucug

SEQ ID NO: 1695 - RNA, 24 nt, Artificial Sequence
  Synthetic Construct
ugaagcgccugugcucugccgaga

SEQ ID NO: 1696 - RNA, 22 nt, Artificial Sequence
  Synthetic Construct
augaagccuucucugccuuacg

SEQ ID NO: 1697 - RNA, 22 nt, Artificial Sequence
  Synthetic Construct
aaaacuaggacuguguggugua

SEQ ID NO: 1698 - RNA, 21 nt, Artificial Sequence
  Synthetic Construct
aagggacagggagggucgugg

SEQ ID NO: 1699 - RNA, 21 nt, Artificial Sequence
  Synthetic Construct
cagcggagccuggagagaagg

SEQ ID NO: 1700 - RNA, 21 nt, Artificial Sequence
  Synthetic Construct
cguggaggacgaggaggaggc

SEQ ID NO: 1701 - RNA, 23 nt, Artificial Sequence
  Synthetic Construct
cuacccucggucugcuuaccaca

SEQ ID NO: 1702 - RNA, 22 nt, Artificial Sequence
  Synthetic Construct
gacaauuguugaucuugggccu

SEQ ID NO: 1703 - RNA, 21 nt, Artificial Sequence
  Synthetic Construct
guuuggacauaguguggcugg

SEQ ID NO: 1704 - RNA, 22 nt, Artificial Sequence
  Synthetic Construct
uaccugggagacugagguugga

SEQ ID NO: 1705 - RNA, 22 nt, Artificial Sequence
  Synthetic Construct
uauguaguagucaaaggcauuu

SEQ ID NO: 1706 - RNA, 21 nt, Artificial Sequence
  Synthetic Construct
ucaaaugcagauccugacuuc

SEQ ID NO: 1707 - RNA, 21 nt, Artificial Sequence
  Synthetic Construct
ugaggugaccgcagaugggaa

SEQ ID NO: 1708 - RNA, 22 nt, Artificial Sequence
  Synthetic Construct
uuggugaggaccccaagcucgg

SEQ ID NO: 1709 - RNA, 21 nt, Artificial Sequence
  Synthetic Construct
uuuuaaggacacugagggauc

SEQ ID NO: 1710 - RNA, 20 nt, Artificial Sequence
  Synthetic Construct
ugugacccuagaauaauuac

SEQ ID NO: 1711 - RNA, 24 nt, Artificial Sequence
  Synthetic Construct
aggcugugaugcucuccugagccc

SEQ ID NO: 1712 - RNA, 18 nt, Artificial Sequence
  Synthetic Construct
auccuagucacggcacca

SEQ ID NO: 1713 - RNA, 19 nt, Artificial Sequence
  Synthetic Construct
ugcccugagacuuuugcuc

SEQ ID NO: 1714 - RNA, 18 nt, Artificial Sequence
  Synthetic Construct
uucccagccaacgcacca

SEQ ID NO: 1715 - RNA, 21 nt, Artificial Sequence
  Synthetic Construct
ucugguguauagcguugcuca

SEQ ID NO: 1716 - RNA, 23 nt, Artificial Sequence
  Synthetic Construct
caguaacaaagauucauccuugu

SEQ ID NO: 1717 - RNA, 22 nt, Artificial Sequence
  Synthetic Construct
cgggacuguagagggcaugagc

SEQ ID NO: 1718 - RNA, 24 nt, Artificial Sequence
  Synthetic Construct
uggcgauuuuggaacucaauggca

SEQ ID NO: 1719 - RNA, 21 nt, Artificial Sequence
  Synthetic Construct
gaaaguacagaucggaugggu

SEQ ID NO: 1720 - RNA, 23 nt, Artificial Sequence
  Synthetic Construct
cuuugagcacaugagcagacgga

SEQ ID NO: 1721 - RNA, 20 nt, Artificial Sequence
  Synthetic Construct
cguggauugucuggaugcau

SEQ ID NO: 1722 - RNA, 21 nt, Artificial Sequence
  Synthetic Construct
guggcucuguaguaagaugga

SEQ ID NO: 1723 - RNA, 22 nt, Artificial Sequence
  Synthetic Construct
cuggacuuugaucuugccauaa

SEQ ID NO: 1724 - RNA, 22 nt, Artificial Sequence
  Synthetic Construct
ggggaacuguagaugaaaaggc

SEQ ID NO: 1725 - RNA, 24 nt, Artificial Sequence
  Synthetic Construct
ccaugaagcaguggguaggaggac

SEQ ID NO: 1726 - RNA, 21 nt, Artificial Sequence
  Synthetic Construct
cuuagauuagaggauauuguu

SEQ ID NO: 1727 - RNA, 21 nt, Artificial Sequence
  Synthetic Construct
cagugauuugaggauuauugc

SEQ ID NO: 1728 - RNA, 22 nt, Artificial Sequence
  Synthetic Construct
ucaaaaucaggagucggggcuu

SEQ ID NO: 1729 - RNA, 20 nt, Artificial Sequence
  Synthetic Construct
agcacacugagcgagcggac

SEQ ID NO: 1730 - RNA, 24 nt, Artificial Sequence
  Synthetic Construct
uguaggaacaguugaauuuuggcu

SEQ ID NO: 1731 - RNA, 21 nt, Artificial Sequence
  Synthetic Construct
caaugugaucuuuuggaugua

SEQ ID NO: 1732 - RNA, 22 nt, Artificial Sequence
  Synthetic Construct
ccuagaaacuguaaacuuaguc

SEQ ID NO: 1733 - RNA, 22 nt, Artificial Sequence
  Synthetic Construct
uguuuguuguaaggaucguugu

SEQ ID NO: 1734 - RNA, 23 nt, Artificial Sequence
  Synthetic Construct
ggaugguugggggcggucggcgu

SEQ ID NO: 1735 - RNA, 22 nt, Artificial Sequence
  Synthetic Construct
augugauugacggcugacucca

SEQ ID NO: 1736 - RNA, 20 nt, Artificial Sequence
  Synthetic Construct
cgguggacuggagugggugg

SEQ ID NO: 1737 - RNA, 20 nt, Artificial Sequence
  Synthetic Construct
ggcggcggggagguaggcag

SEQ ID NO: 1738 - RNA, 22 nt, Artificial Sequence
  Synthetic Construct
accuggcagcagggagcgucgu

SEQ ID NO: 1739 - RNA, 24 nt, Artificial Sequence
  Synthetic Construct
cuauggcgagacuggcauguacuc

SEQ ID NO: 1740 - RNA, 24 nt, Artificial Sequence
  Synthetic Construct
ugcugauggcagaugucgggucug

SEQ ID NO: 1741 - RNA, 24 nt, Artificial Sequence
  Synthetic Construct
uauauggacuuuucugauacaaug

SEQ ID NO: 1742 - RNA, 22 nt, Artificial Sequence
  Synthetic Construct
ggcugagugggguucugacucc

SEQ ID NO: 1743 - RNA, 23 nt, Artificial Sequence
  Synthetic Construct
ggucuaggcccggugagagacuc

SEQ ID NO: 1744 - RNA, 20 nt, Artificial Sequence
  Synthetic Construct
cagugaucgucucugcuggc

SEQ ID NO: 1745 - RNA, 23 nt, Artificial Sequence
  Synthetic Construct
gaaggacacuggugucaacggcu

SEQ ID NO: 1746 - RNA, 23 nt, Artificial Sequence
  Synthetic Construct
cuugagucgugccuuucugaaug

SEQ ID NO: 1747 - RNA, 22 nt, Artificial Sequence
  Synthetic Construct
ugauggagcugggaauacucug

SEQ ID NO: 1748 - RNA, 21 nt, Artificial Sequence
  Synthetic Construct
caggacuugacggcugcaacu

SEQ ID NO: 1749 - RNA, 23 nt, Artificial Sequence
  Synthetic Construct
gaauacuaaguaaaaaaucagua

SEQ ID NO: 1750 - RNA, 21 nt, Artificial Sequence
  Synthetic Construct
ugggagagaggacugugaggc

SEQ ID NO: 1751 - RNA, 22 nt, Artificial Sequence
  Synthetic Construct
ugcuagucuggacugauauggu

SEQ ID NO: 1752 - RNA, 23 nt, Artificial Sequence
  Synthetic Construct
gaagacuucuuggauuacagggg

SEQ ID NO: 1753 - RNA, 21 nt, Artificial Sequence
  Synthetic Construct
ccucgguacuggaaaggggua

SEQ ID NO: 1754 - RNA, 24 nt, Artificial Sequence
  Synthetic Construct
ccuggggacaggggauuggggcag

SEQ ID NO: 1755 - RNA, 21 nt, Artificial Sequence
  Synthetic Construct
cacacacacacacacacguau

SEQ ID NO: 1756 - RNA, 21 nt, Artificial Sequence
  Synthetic Construct
gcaggaacuugugagucuccu

SEQ ID NO: 1757 - RNA, 23 nt, Artificial Sequence
  Synthetic Construct
cggccccacgcaccaggguaaga

SEQ ID NO: 1758 - RNA, 22 nt, Artificial Sequence
  Synthetic Construct
uauaccucaguuuuaucaggug

SEQ ID NO: 1759 - RNA, 22 nt, Artificial Sequence
  Synthetic Construct
uggauuucuuugugaaucacca

SEQ ID NO: 1760 - RNA, 21 nt, Artificial Sequence
  Synthetic Construct
uccucuucucccuccucccag

SEQ ID NO: 1761 - RNA, 22 nt, Artificial Sequence
  Synthetic Construct
uccauuacacuacccugccucu

SEQ ID NO: 1762 - RNA, 21 nt, Artificial Sequence
  Synthetic Construct
cuugggagcccuguuagacuc

SEQ ID NO: 1763 - RNA, 21 nt, Artificial Sequence
  Synthetic Construct
uacucaaaaagcugucaguca

SEQ ID NO: 1764 - RNA, 22 nt, Artificial Sequence
  Synthetic Construct
aauggcuguccguaguaugguc

SEQ ID NO: 1765 - RNA, 21 nt, Artificial Sequence
  Synthetic Construct
uacuuggaaaggcaucaguug

SEQ ID NO: 1766 - RNA, 22 nt, Artificial Sequence
  Synthetic Construct
aguggcacauguuuguugugag

SEQ ID NO: 1767 - RNA, 22 nt, Artificial Sequence
  Synthetic Construct
ugcaacuuaccugagucauuga

SEQ ID NO: 1768 - RNA, 21 nt, Artificial Sequence
  Synthetic Construct
cacuguguccuuucugcguag

SEQ ID NO: 1769 - RNA, 22 nt, Artificial Sequence
  Synthetic Construct
cacuggcuccuuucuggguaga

SEQ ID NO: 1770 - RNA, 22 nt, Artificial Sequence
  Synthetic Construct
cacuguuuccuuucugagugga

SEQ ID NO: 1771 - RNA, 23 nt, Artificial Sequence
  Synthetic Construct
ucuuugguuaucuagcuguauga

SEQ ID NO: 1772 - RNA, 20 nt, Artificial Sequence
  Synthetic Construct
ggggagcuguggaagcagua

SEQ ID NO: 1773 - RNA, 25 nt, Artificial Sequence
  Synthetic Construct
cuagugagggacagaaccaggauuc

SEQ ID NO: 1774 - RNA, 23 nt, Artificial Sequence
  Synthetic Construct
gcagcagagaauaggacuacguc

SEQ ID NO: 1775 - RNA, 20 nt, Artificial Sequence
  Synthetic Construct
agagucuugugaugucuugc

SEQ ID NO: 1776 - RNA, 22 nt, Artificial Sequence
  Synthetic Construct
uauugcacuugucccggccugu

SEQ ID NO: 1777 - RNA, 22 nt, Artificial Sequence
  Synthetic Construct
uauugcacuugucccggccugu

SEQ ID NO: 1778 - RNA, 22 nt, Artificial Sequence
  Synthetic Construct
uauugcacucgucccggccucc

SEQ ID NO: 1779 - RNA, 22 nt, Artificial Sequence
  Synthetic Construct
acugcugagcuagcacuucccg

SEQ ID NO: 1780 - RNA, 22 nt, Artificial Sequence
  Synthetic Construct
ugugcgcagggagaccucuccc

SEQ ID NO: 1781 - RNA, 22 nt, Artificial Sequence
  Synthetic Construct
ugucuacuacuggagacacugg

SEQ ID NO: 1782 - RNA, 23 nt, Artificial Sequence
  Synthetic Construct
ccaguuaccgcuuccgcuaccgc

SEQ ID NO: 1783 - RNA, 22 nt, Artificial Sequence
  Synthetic Construct
acaguagagggaggaaucgcag

SEQ ID NO: 1784 - RNA, 22 nt, Artificial Sequence
  Synthetic Construct
auccgcgcucugacucucugcc

SEQ ID NO: 1785 - RNA, 22 nt, Artificial Sequence
  Synthetic Construct
ugcccuuaaaggugaacccagu

SEQ ID NO: 1786 - RNA, 21 nt, Artificial Sequence
  Synthetic Construct
cccugggccucugcuccccag

SEQ ID NO: 1787 - RNA, 21 nt, Artificial Sequence
  Synthetic Construct
aaggcagggcccccgcucccc

SEQ ID NO: 1788 - RNA, 23 nt, Artificial Sequence
  Synthetic Construct
cacccggcugugugcacaugugc

SEQ ID NO: 1789 - RNA, 22 nt, Artificial Sequence
  Synthetic Construct
ucuucucuguuuuggccaugug

SEQ ID NO: 1790 - RNA, 21 nt, Artificial Sequence
  Synthetic Construct
cugacuguugccguccuccag

SEQ ID NO: 1791 - RNA, 22 nt, Artificial Sequence
  Synthetic Construct
aaauuauuguacaucggaugag

SEQ ID NO: 1792 - RNA, 21 nt, Artificial Sequence
  Synthetic Construct
ucaauaaaugucuguugaauu

SEQ ID NO: 1793 - RNA, 19 nt, Artificial Sequence
  Synthetic Construct
aagggaagauggugaccac

SEQ ID NO: 1794 - RNA, 23 nt, Artificial Sequence
  Synthetic Construct
uuuggcacuagcacauuuuugcu

SEQ ID NO: 1795 - RNA, 22 nt, Artificial Sequence
  Synthetic Construct
cuauacaacuuacuacuuuccc

SEQ ID NO: 1796 - RNA, 22 nt, Artificial Sequence
  Synthetic Construct
caagcucgcuucuaugggucug

SEQ ID NO: 1797 - RNA, 22 nt, Artificial Sequence
  Synthetic Construct
cacccguagaaccgaccuugcg

SEQ ID NO: 1798 - RNA, 21 nt, Artificial Sequence
  Synthetic Construct
cuauacaaucuacugucuuuc

SEQ ID NO: 1799 - RNA, 22 nt, Artificial Sequence
  Synthetic Construct
cuguacagccuccuagcuuucc

SEQ ID NO: 1800 - RNA, 22 nt, Artificial Sequence
  Synthetic Construct
ugagguaguagguugugugguu

SEQ ID NO: 1801 - RNA, 22 nt, Artificial Sequence
  Synthetic Construct
cuguacaaccuucuagcuuucc

SEQ ID NO: 1802 - RNA, 22 nt, Artificial Sequence
  Synthetic Construct
agagguaguagguugcauaguu

SEQ ID NO: 1803 - RNA, 22 nt, Artificial Sequence
  Synthetic Construct
ugagguaggagguuguauaguu

SEQ ID NO: 1804 - RNA, 22 nt, Artificial Sequence
  Synthetic Construct
cuauacaaucuauugccuuccc

SEQ ID NO: 1805 - RNA, 22 nt, Artificial Sequence
  Synthetic Construct
cuauacagucuacugucuuucc

SEQ ID NO: 1806 - RNA, 22 nt, Artificial Sequence
  Synthetic Construct
ugagguaguaguuuguacaguu

SEQ ID NO: 1807 - RNA, 22 nt, Artificial Sequence
  Synthetic Construct
cugcgcaagcuacugccuugcu

SEQ ID NO: 1808 - RNA, 22 nt, Artificial Sequence
  Synthetic Construct
acauacuucuuuauaugcccau

SEQ ID NO: 1809 - RNA, 22 nt, Artificial Sequence
  Synthetic Construct
aacccguagauccgaacuugug

SEQ ID NO: 1810 - RNA, 22 nt, Artificial Sequence
  Synthetic Construct
caguuaucacagugcugaugcu

SEQ ID NO: 1811 - RNA, 23 nt, Artificial Sequence
  Synthetic Construct
agcuucuuuacagugcugccuug

SEQ ID NO: 1812 - RNA, 23 nt, Artificial Sequence
  Synthetic Construct
cagcauuguacagggcuaugauu

SEQ ID NO: 1813 - RNA, 22 nt, Artificial Sequence
  Synthetic Construct
acggauguuugagcaugugcua

SEQ ID NO: 1814 - RNA, 23 nt, Artificial Sequence
  Synthetic Construct
aaaagugcuuacagugcagguag

SEQ ID NO: 1815 - RNA, 22 nt, Artificial Sequence
  Synthetic Construct
ccgcacuguggguacuugcugc

SEQ ID NO: 1816 - RNA, 23 nt, Artificial Sequence
  Synthetic Construct
auagcccuguacaaugcugcuuu

SEQ ID NO: 1817 - RNA, 23 nt, Artificial Sequence
  Synthetic Construct
uacccuguagauccgaauuugug

SEQ ID NO: 1818 - RNA, 23 nt, Artificial Sequence
  Synthetic Construct
uacccuguagaaccgaauuugug

SEQ ID NO: 1819 - RNA, 18 nt, Artificial Sequence
  Synthetic Construct
cagggucagcugagcaug

SEQ ID NO: 1820 - RNA, 21 nt, Artificial Sequence
  Synthetic Construct
aaccaaugaaagaaugcuuuu

SEQ ID NO: 1821 - RNA, 21 nt, Artificial Sequence
  Synthetic Construct
ggacccacccggccgggaaua

SEQ ID NO: 1822 - RNA, 21 nt, Artificial Sequence
  Synthetic Construct
gcucggguggcggcgacgguu

SEQ ID NO: 1823 - RNA, 23 nt, Artificial Sequence
  Synthetic Construct
cacaucccucccaagacccucuu

SEQ ID NO: 1824 - RNA, 27 nt, Artificial Sequence
  Synthetic Construct
cccacucucaccaucaccuacaguguu

SEQ ID NO: 1825 - RNA, 23 nt, Artificial Sequence
  Synthetic Construct
aagccaucaagucgcugcagguu

SEQ ID NO: 1826 - RNA, 22 nt, Artificial Sequence
  Synthetic Construct
auauacagggggagacucuuau

SEQ ID NO: 1827 - RNA, 22 nt, Artificial Sequence
  Synthetic Construct
auauacagggggagacucucau

SEQ ID NO: 1828 - RNA, 23 nt, Artificial Sequence
  Synthetic Construct
acgucaccggucuaccaucccuu

SEQ ID NO: 1829 - RNA, 21 nt, Artificial Sequence
  Synthetic Construct
aaguagaccauguguccuauu

SEQ ID NO: 1830 - RNA, 21 nt, Artificial Sequence
  Synthetic Construct
ugcggccggugcucaaccugc

SEQ ID NO: 1831 - RNA, 22 nt, Artificial Sequence
  Synthetic Construct
ggcucagaauggcucaggaguu

SEQ ID NO: 1832 - RNA, 21 nt, Artificial Sequence
  Synthetic Construct
cccccacugcagcuggcacuu

SEQ ID NO: 1833 - RNA, 21 nt, Artificial Sequence
  Synthetic Construct
gcugcauccuggcuccggguu

SEQ ID NO: 1834 - RNA, 21 nt, Artificial Sequence
  Synthetic Construct
aauggagaccaggccacgauu

SEQ ID NO: 1835 - RNA, 20 nt, Artificial Sequence
  Synthetic Construct
caaagcaaacccugcagauu

SEQ ID NO: 1836 - RNA, 21 nt, Artificial Sequence
  Synthetic Construct
uuaaacaucuacaugaacauu

SEQ ID NO: 1837 - RNA, 18 nt, Artificial Sequence
  Synthetic Construct
ucagcuggcccucauuuc

SEQ ID NO: 1838 - RNA, 20 nt, Artificial Sequence
  Synthetic Construct
cgccugucugaacagugauu

SEQ ID NO: 1839 - RNA, 22 nt, Artificial Sequence
  Synthetic Construct
aacgccauuaucacacuaaaua

SEQ ID NO: 1840 - RNA, 19 nt, Artificial Sequence
  Synthetic Construct
gugaggacucgggaggugg

SEQ ID NO: 1841 - RNA, 22 nt, Artificial Sequence
  Synthetic Construct
ugagccccugugccgcccccag

SEQ ID NO: 1842 - RNA, 22 nt, Artificial Sequence
  Synthetic Construct
ucaccagcccuguguucccuag

SEQ ID NO: 1843 - RNA, 20 nt, Artificial Sequence
  Synthetic Construct
cgugccacccuuuuccccag

SEQ ID NO: 1844 - RNA, 20 nt, Artificial Sequence
  Synthetic Construct
ucacaccugccucgcccccc

SEQ ID NO: 1845 - RNA, 23 nt, Artificial Sequence
  Synthetic Construct
cucucaccacugcccucccacag

SEQ ID NO: 1846 - RNA, 20 nt, Artificial Sequence
  Synthetic Construct
agcuguccgcccagacacuu

SEQ ID NO: 1847 - RNA, 20 nt, Artificial Sequence
  Synthetic Construct
ugagcccuguccucccgcag

SEQ ID NO: 1848 - RNA, 22 nt, Artificial Sequence
  Synthetic Construct
gggguggguggucaggccgauu

SEQ ID NO: 1849 - RNA, 22 nt, Artificial Sequence
  Synthetic Construct
ccucuuccccuugucucuccag

SEQ ID NO: 1850 - RNA, 21 nt, Artificial Sequence
  Synthetic Construct
uccuucugcuccgucccccag

SEQ ID NO: 1851 - RNA, 23 nt, Artificial Sequence
  Synthetic Construct
gugagugggagccccagugugug

SEQ ID NO: 1852 - RNA, 22 nt, Artificial Sequence
  Synthetic Construct
cguguucacagcggaccuugau

SEQ ID NO: 1853 - RNA, 22 nt, Artificial Sequence
  Synthetic Construct
cuccuauaauugauccaguuuu

SEQ ID NO: 1854 - RNA, 26 nt, Artificial Sequence
  Synthetic Construct
ccaucucauacaaaccaacuacuuuu

SEQ ID NO: 1855 - RNA, 21 nt, Artificial Sequence
  Synthetic Construct
guaggccuuuagaucacuuuu

SEQ ID NO: 1856 - RNA, 21 nt, Artificial Sequence
  Synthetic Construct
uaggccuuuagaucacuuaaa

SEQ ID NO: 1857 - RNA, 19 nt, Artificial Sequence
  Synthetic Construct
ugcuccaaaaauccauuuu

SEQ ID NO: 1858 - RNA, 22 nt, Artificial Sequence
  Synthetic Construct
acccgucccguucguccccgga

SEQ ID NO: 1859 - RNA, 27 nt, Artificial Sequence
  Synthetic Construct
uagcacagugcuuauacaagaagguuu

SEQ ID NO: 1860 - RNA, 24 nt, Artificial Sequence
  Synthetic Construct
aggagggaggagaugggccaaguu

SEQ ID NO: 1861 - RNA, 21 nt, Artificial Sequence
  Synthetic Construct
acggugcuggauguggccuuu

SEQ ID NO: 1862 - RNA, 21 nt, Artificial Sequence
  Synthetic Construct
acucuagcugccaaaggcgcu

SEQ ID NO: 1863 - RNA, 22 nt, Artificial Sequence
  Synthetic Construct
caaaugagcuuaauuuccuuuu

SEQ ID NO: 1864 - RNA, 21 nt, Artificial Sequence
  Synthetic Construct
caggcugaucuucuucucuuu

SEQ ID NO: 1865 - RNA, 24 nt, Artificial Sequence
  Synthetic Construct
ugcaggcuccagcuuccaggcuuu

SEQ ID NO: 1866 - RNA, 23 nt, Artificial Sequence
  Synthetic Construct
ucuacuuucuuugcucauccuuu

SEQ ID NO: 1867 - RNA, 22 nt, Artificial Sequence
  Synthetic Construct
cggaugagcaaagaaagugguu

SEQ ID NO: 1868 - RNA, 22 nt, Artificial Sequence
  Synthetic Construct
cuagugagaagucaaugccuuu

SEQ ID NO: 1869 - RNA, 21 nt, Artificial Sequence
  Synthetic Construct
ucagaacccaucauucacuuu

SEQ ID NO: 1870 - RNA, 21 nt, Artificial Sequence
  Synthetic Construct
ccacgaccuaauccuaacuuu

SEQ ID NO: 1871 - RNA, 24 nt, Artificial Sequence
  Synthetic Construct
ucccugagacccuuuaaccuguga

SEQ ID NO: 1872 - RNA, 22 nt, Artificial Sequence
  Synthetic Construct
acggguuaggcucuugggagcu

SEQ ID NO: 1873 - RNA, 22 nt, Artificial Sequence
  Synthetic Construct
ucacaagucaggcucuugggac

SEQ ID NO: 1874 - RNA, 21 nt, Artificial Sequence
  Synthetic Construct
cauuauuacuuuugguacgcg

SEQ ID NO: 1875 - RNA, 18 nt, Artificial Sequence
  Synthetic Construct
guggcagaggugggauuu

SEQ ID NO: 1876 - RNA, 19 nt, Artificial Sequence
  Synthetic Construct
gguggcaguggugggauuu

SEQ ID NO: 1877 - RNA, 19 nt, Artificial Sequence
  Synthetic Construct
gccaaagccuuauccauuu

SEQ ID NO: 1878 - RNA, 22 nt, Artificial Sequence
  Synthetic Construct
ccuucuacaaauucacccauuu

SEQ ID NO: 1879 - RNA, 22 nt, Artificial Sequence
  Synthetic Construct
ucaguaugccaggguaccauuu

SEQ ID NO: 1880 - RNA, 23 nt, Artificial Sequence
  Synthetic Construct
caggugcucaaauaagacuuguu

SEQ ID NO: 1881 - RNA, 22 nt, Artificial Sequence
  Synthetic Construct
caacacuugaccacauccuguu

SEQ ID NO: 1882 - RNA, 22 nt, Artificial Sequence
  Synthetic Construct
cccuguucuaugcccugaggga

SEQ ID NO: 1883 - RNA, 21 nt, Artificial Sequence
  Synthetic Construct
gggauuacacuucaacagguu

SEQ ID NO: 1884 - RNA, 18 nt, Artificial Sequence
  Synthetic Construct
cccaccaccacgcccguu

SEQ ID NO: 1885 - RNA, 20 nt, Artificial Sequence
  Synthetic Construct
cccccaccaccacgcccguu

SEQ ID NO: 1886 - RNA, 22 nt, Artificial Sequence
  Synthetic Construct
aguagcacggcucaguccaguu

SEQ ID NO: 1887 - RNA, 22 nt, Artificial Sequence
  Synthetic Construct
aguagcauggcucaguccaguu

SEQ ID NO: 1888 - RNA, 22 nt, Artificial Sequence
  Synthetic Construct
cugaagcucagagggcucugau

SEQ ID NO: 1889 - RNA, 23 nt, Artificial Sequence
  Synthetic Construct
acagcucuuccauaucuccaguu

SEQ ID NO: 1890 - RNA, 22 nt, Artificial Sequence
  Synthetic Construct
cuuggcaccuagcaagcacuca

SEQ ID NO: 1891 - RNA, 26 nt, Artificial Sequence
  Synthetic Construct
ucagaauuugcugccaucaucaucuu

SEQ ID NO: 1892 - RNA, 25 nt, Artificial Sequence
  Synthetic Construct
gaaagagucuugcuuugucgcccuu

SEQ ID NO: 1893 - RNA, 22 nt, Artificial Sequence
  Synthetic Construct
cagggucucguuuugucgccuu

SEQ ID NO: 1894 - RNA, 25 nt, Artificial Sequence
  Synthetic Construct
ugcagccucaaccucauggguucuu

SEQ ID NO: 1895 - RNA, 22 nt, Artificial Sequence
  Synthetic Construct
cacuuccuggguucaagcaauu

SEQ ID NO: 1896 - RNA, 19 nt, Artificial Sequence
  Synthetic Construct
cugcaaccuccaucuccuu

SEQ ID NO: 1897 - RNA, 21 nt, Artificial Sequence
  Synthetic Construct
accacugcacuccagccugag

SEQ ID NO: 1898 - RNA, 22 nt, Artificial Sequence
  Synthetic Construct
cugcagacucgaccucccaggc

SEQ ID NO: 1899 - RNA, 17 nt, Artificial Sequence
  Synthetic Construct
cagccucucccccacuu

SEQ ID NO: 1900 - RNA, 20 nt, Artificial Sequence
  Synthetic Construct
ucuccacagggcucuuuauu

SEQ ID NO: 1901 - RNA, 24 nt, Artificial Sequence
  Synthetic Construct
aaauauauauauauauguacguau

SEQ ID NO: 1902 - RNA, 22 nt, Artificial Sequence
  Synthetic Construct
agaugauaugcacaguacuauu

SEQ ID NO: 1903 - RNA, 17 nt, Artificial Sequence
  Synthetic Construct
aaagaagcaauaugauu

SEQ ID NO: 1904 - RNA, 23 nt, Artificial Sequence
  Synthetic Construct
cggggccguagcacugucugaga

SEQ ID NO: 1905 - RNA, 23 nt, Artificial Sequence
  Synthetic Construct
gggggccgauacacuguacgaga

SEQ ID NO: 1906 - RNA, 17 nt, Artificial Sequence
  Synthetic Construct
gagaggaggaggcgauu

SEQ ID NO: 1907 - RNA, 20 nt, Artificial Sequence
  Synthetic Construct
gcagaaaaaggcaaacgauu

SEQ ID NO: 1908 - RNA, 22 nt, Artificial Sequence
  Synthetic Construct
aaagcgcuuuccuuuguagauu

SEQ ID NO: 1909 - RNA, 22 nt, Artificial Sequence
  Synthetic Construct
aaagccagggucuguauagauu

SEQ ID NO: 1910 - RNA, 21 nt, Artificial Sequence
  Synthetic Construct
gaucucacuuuguugcccagg

SEQ ID NO: 1911 - RNA, 21 nt, Artificial Sequence
  Synthetic Construct
ggcucaucuugguccugcauu

SEQ ID NO: 1912 - RNA, 22 nt, Artificial Sequence
  Synthetic Construct
ugcuggaucagugguucgaguc

SEQ ID NO: 1913 - RNA, 23 nt, Artificial Sequence
  Synthetic Construct
gcagaucaggacuguaacucacc

SEQ ID NO: 1914 - RNA, 23 nt, Artificial Sequence
  Synthetic Construct
aaugcagauuccuggacuccauu

SEQ ID NO: 1915 - RNA, 22 nt, Artificial Sequence
  Synthetic Construct
aagcccuuaccccaaaaaguau

SEQ ID NO: 1916 - RNA, 22 nt, Artificial Sequence
  Synthetic Construct
aagcccuuaccccaaaaagcau

SEQ ID NO: 1917 - RNA, 19 nt, Artificial Sequence
  Synthetic Construct
ccugauccaaaaauccauu

SEQ ID NO: 1918 - RNA, 24 nt, Artificial Sequence
  Synthetic Construct
ugcuggucuucagucagggccauu

SEQ ID NO: 1919 - RNA, 20 nt, Artificial Sequence
  Synthetic Construct
ucgcgccccggcucccguuc

SEQ ID NO: 1920 - RNA, 22 nt, Artificial Sequence
  Synthetic Construct
acaaaucuccagaccacccauu

SEQ ID NO: 1921 - RNA, 22 nt, Artificial Sequence
  Synthetic Construct
acaacaaugccaaccucacauu

SEQ ID NO: 1922 - RNA, 21 nt, Artificial Sequence
  Synthetic Construct
acccagaucugcggccuaauu

SEQ ID NO: 1923 - RNA, 21 nt, Artificial Sequence
  Synthetic Construct
cacccagaucugcggccuaau

SEQ ID NO: 1924 - RNA, 22 nt, Artificial Sequence
  Synthetic Construct
gaguggggcuucgacccuaacc

SEQ ID NO: 1925 - RNA, 17 nt, Artificial Sequence
  Synthetic Construct
ccugaauuacuugaauu

SEQ ID NO: 1926 - RNA, 22 nt, Artificial Sequence
  Synthetic Construct
uucauucggcuguccagaugua

SEQ ID NO: 1927 - RNA, 22 nt, Artificial Sequence
  Synthetic Construct
ccucacacagaauuccagaauu

SEQ ID NO: 1928 - RNA, 24 nt, Artificial Sequence
  Synthetic Construct
uugcagcugccugggagugacuuc

SEQ ID NO: 1929 - RNA, 21 nt, Artificial Sequence
  Synthetic Construct
uagcauaaguaugucccaauu

SEQ ID NO: 1930 - RNA, 22 nt, Artificial Sequence
  Synthetic Construct
agcaagaccccgucucuaaauu

SEQ ID NO: 1931 - RNA, 22 nt, Artificial Sequence
  Synthetic Construct
ucucacuguagccucgaacccc

SEQ ID NO: 1932 - RNA, 22 nt, Artificial Sequence
  Synthetic Construct
ucucccauuagaguugaaaauu

SEQ ID NO: 1933 - RNA, 18 nt, Artificial Sequence
  Synthetic Construct
acguuggcucugguggug

SEQ ID NO: 1934 - RNA, 21 nt, Artificial Sequence
  Synthetic Construct
ucgaccggaccucgaccggcu

SEQ ID NO: 1935 - RNA, 22 nt, Artificial Sequence
  Synthetic Construct
cagugcaauguuaaaagggcau

SEQ ID NO: 1936 - RNA, 21 nt, Artificial Sequence
  Synthetic Construct
acucuuucccuguugcacuac

SEQ ID NO: 1937 - RNA, 22 nt, Artificial Sequence
  Synthetic Construct
accguggcuuucgauuguuacu

SEQ ID NO: 1938 - RNA, 18 nt, Artificial Sequence
  Synthetic Construct
cacauucaccucccuguu

SEQ ID NO: 1939 - RNA, 19 nt, Artificial Sequence
  Synthetic Construct
gcaucagcagcaucaucuu

SEQ ID NO: 1940 - RNA, 22 nt, Artificial Sequence
  Synthetic Construct
aaaaugccccucaguuuugauu

SEQ ID NO: 1941 - RNA, 24 nt, Artificial Sequence
  Synthetic Construct
aagugcauagaauucugucugguu

SEQ ID NO: 1942 - RNA, 22 nt, Artificial Sequence
  Synthetic Construct
uuugguccccuucaaccagcug

SEQ ID NO: 1943 - RNA, 22 nt, Artificial Sequence
  Synthetic Construct
gcugguugaaggggaccaaauu

SEQ ID NO: 1944 - RNA, 23 nt, Artificial Sequence
  Synthetic Construct
ccugugggccaccuagucaccaa

SEQ ID NO: 1945 - RNA, 22 nt, Artificial Sequence
  Synthetic Construct
uggggagcggcccccggguggg

SEQ ID NO: 1946 - RNA, 23 nt, Artificial Sequence
  Synthetic Construct
uauggcuuuuuauuccuauguga

SEQ ID NO: 1947 - RNA, 23 nt, Artificial Sequence
  Synthetic Construct
uauggcuuuucauuccuauguga

SEQ ID NO: 1948 - RNA, 23 nt, Artificial Sequence
  Synthetic Construct
acuccauuuguuuugaugaugga

SEQ ID NO: 1949 - RNA, 23 nt, Artificial Sequence
  Synthetic Construct
acgcguauucuuaagcaauaauu

SEQ ID NO: 1950 - RNA, 22 nt, Artificial Sequence
  Synthetic Construct
gcuacuucacaacaccagggcc

SEQ ID NO: 1951 - RNA, 22 nt, Artificial Sequence
  Synthetic Construct
gcuauuucacgacaccaggguu

SEQ ID NO: 1952 - RNA, 23 nt, Artificial Sequence
  Synthetic Construct
uggagacgcggcccuguuggagu

SEQ ID NO: 1953 - RNA, 21 nt, Artificial Sequence
  Synthetic Construct
uaccacaggguagaaccacgg

SEQ ID NO: 1954 - RNA, 22 nt, Artificial Sequence
  Synthetic Construct
caucuuccaguacaguguugga

SEQ ID NO: 1955 - RNA, 23 nt, Artificial Sequence
  Synthetic Construct
uguaguguuuccuacuuuaugga

SEQ ID NO: 1956 - RNA, 21 nt, Artificial Sequence
  Synthetic Construct
ugagaugaagcacuguagcuc

SEQ ID NO: 1957 - RNA, 22 nt, Artificial Sequence
  Synthetic Construct
ggauaucaucauauacuguaag

SEQ ID NO: 1958 - RNA, 22 nt, Artificial Sequence
  Synthetic Construct
ggauuccuggaaauacuguucu

SEQ ID NO: 1959 - RNA, 22 nt, Artificial Sequence
  Synthetic Construct
agcaaaauaagcaaauggaaaa

SEQ ID NO: 1960 - RNA, 22 nt, Artificial Sequence
  Synthetic Construct
agcccgcgccccgcgccgaguu

SEQ ID NO: 1961 - RNA, 22 nt, Artificial Sequence
  Synthetic Construct
ccucugaaauucaguucuucag

SEQ ID NO: 1962 - RNA, 22 nt, Artificial Sequence
  Synthetic Construct
ugagaacugaauuccauaggcu

SEQ ID NO: 1963 - RNA, 21 nt, Artificial Sequence
  Synthetic Construct
gggugcacgggcggagggcuu

SEQ ID NO: 1964 - RNA, 22 nt, Artificial Sequence
  Synthetic Construct
accuggcuccacacgcgggcuu

SEQ ID NO: 1965 - RNA, 20 nt, Artificial Sequence
  Synthetic Construct
agaagcauuuccacacacuu

SEQ ID NO: 1966 - RNA, 22 nt, Artificial Sequence
  Synthetic Construct
gcagaagcauuuccgcacacuu

SEQ ID NO: 1967 - RNA, 22 nt, Artificial Sequence
  Synthetic Construct
ucagugcacuacagaacuuugu

SEQ ID NO: 1968 - RNA, 22 nt, Artificial Sequence
  Synthetic Construct
ucagugcaucacagaacuuugu

SEQ ID NO: 1969 - RNA, 23 nt, Artificial Sequence
  Synthetic Construct
ucuggcuccgugucuucacuccc

SEQ ID NO: 1970 - RNA, 22 nt, Artificial Sequence
  Synthetic Construct
ucucccaacccuuguaccagug

SEQ ID NO: 1971 - RNA, 21 nt, Artificial Sequence
  Synthetic Construct
cuagacugaagcuccuugagg

SEQ ID NO: 1972 - RNA, 18 nt, Artificial Sequence
  Synthetic Construct
acugugagcuccucgauu

SEQ ID NO: 1973 - RNA, 21 nt, Artificial Sequence
  Synthetic Construct
ucagugcaugacagaacuugg

SEQ ID NO: 1974 - RNA, 22 nt, Artificial Sequence
  Synthetic Construct
uugcauagucacaaaagugauc

SEQ ID NO: 1975 - RNA, 22 nt, Artificial Sequence
  Synthetic Construct
aaaaccgucuaguuacaguugu

SEQ ID NO: 1976 - RNA, 23 nt, Artificial Sequence
  Synthetic Construct
gaacagcagcagcccgggccguu

SEQ ID NO: 1977 - RNA, 21 nt, Artificial Sequence
  Synthetic Construct
gcaucugggacgcgcaggauu

SEQ ID NO: 1978 - RNA, 22 nt, Artificial Sequence
  Synthetic Construct
uagguuauccguguugccuucg

SEQ ID NO: 1979 - RNA, 23 nt, Artificial Sequence
  Synthetic Construct
uuaaugcuaaucgugauaggggu

SEQ ID NO: 1980 - RNA, 20 nt, Artificial Sequence
  Synthetic Construct
caacccagcccagcccaauu

SEQ ID NO: 1981 - RNA, 22 nt, Artificial Sequence
  Synthetic Construct
uagcagcacauaaugguuugug

SEQ ID NO: 1982 - RNA, 22 nt, Artificial Sequence
  Synthetic Construct
uagcagcacaucaugguuuaca

SEQ ID NO: 1983 - RNA, 22 nt, Artificial Sequence
  Synthetic Construct
ccaguauuaacugugcugcuga

SEQ ID NO: 1984 - RNA, 22 nt, Artificial Sequence
  Synthetic Construct
ccaauauuacugugcugcuuua

SEQ ID NO: 1985 - RNA, 23 nt, Artificial Sequence
  Synthetic Construct
caaagugcuuacagugcagguag

SEQ ID NO: 1986 - RNA, 22 nt, Artificial Sequence
  Synthetic Construct
accaucgaccguugauuguacc

SEQ ID NO: 1987 - RNA, 22 nt, Artificial Sequence
  Synthetic Construct
accacugaccguugacuguacc

SEQ ID NO: 1988 - RNA, 21 nt, Artificial Sequence
  Synthetic Construct
cucacugaacaaugaaugcaa

SEQ ID NO: 1989 - RNA, 20 nt, Artificial Sequence
  Synthetic Construct
cucacugaucaaugaaugca

SEQ ID NO: 1990 - RNA, 22 nt, Artificial Sequence
  Synthetic Construct
aacauucaaccugucggugagu

SEQ ID NO: 1991 - RNA, 23 nt, Artificial Sequence
  Synthetic Construct
aacauucauuguugucggugggu

SEQ ID NO: 1992 - RNA, 21 nt, Artificial Sequence
  Synthetic Construct
ugguucuagacuugccaacua

SEQ ID NO: 1993 - RNA, 18 nt, Artificial Sequence
  Synthetic Construct
agaggagggcacuggauu

SEQ ID NO: 1994 - RNA, 18 nt, Artificial Sequence
  Synthetic Construct
ucaaucuacugccucauu

SEQ ID NO: 1995 - RNA, 22 nt, Artificial Sequence
  Synthetic Construct
gugaauuaccgaagggccauaa

SEQ ID NO: 1996 - RNA, 22 nt, Artificial Sequence
  Synthetic Construct
ccuuaucaguucuccguccauu

SEQ ID NO: 1997 - RNA, 22 nt, Artificial Sequence
  Synthetic Construct
uggagagaaaggcaguuccuga

SEQ ID NO: 1998 - RNA, 22 nt, Artificial Sequence
  Synthetic Construct
gcccaaaggugaauuuuuuggg

SEQ ID NO: 1999 - RNA, 22 nt, Artificial Sequence
  Synthetic Construct
ggcuacaacacaggacccgggc

SEQ ID NO: 2000 - RNA, 21 nt, Artificial Sequence
  Synthetic Construct
cucccacaugcaggguuugca

SEQ ID NO: 2001 - RNA, 23 nt, Artificial Sequence
  Synthetic Construct
acugcccuaagugcuccuucugg

SEQ ID NO: 2002 - RNA, 22 nt, Artificial Sequence
  Synthetic Construct
ugcccuaaaugccccuucuggc

SEQ ID NO: 2003 - RNA, 21 nt, Artificial Sequence
  Synthetic Construct
ccggccgccggcuccgccccg

SEQ ID NO: 2004 - RNA, 21 nt, Artificial Sequence
  Synthetic Construct
ugagugccggugccugcccug

SEQ ID NO: 2005 - RNA, 21 nt, Artificial Sequence
  Synthetic Construct
cuauauaucaaacauauuccu

SEQ ID NO: 2006 - RNA, 21 nt, Artificial Sequence
  Synthetic Construct
cccaauaucaaacauaucauu

SEQ ID NO: 2007 - RNA, 23 nt, Artificial Sequence
  Synthetic Construct
caacggaaucccaaaagcagcug

SEQ ID NO: 2008 - RNA, 20 nt, Artificial Sequence
  Synthetic Construct
gaggcagaagcaggaugaca

SEQ ID NO: 2009 - RNA, 23 nt, Artificial Sequence
  Synthetic Construct
ugaguaccgccaugucuguuggg

SEQ ID NO: 2010 - RNA, 22 nt, Artificial Sequence
  Synthetic Construct
cacacugcaugcucuggguauu

SEQ ID NO: 2011 - RNA, 22 nt, Artificial Sequence
  Synthetic Construct
gcagcagcggagggggcagauu

SEQ ID NO: 2012 - RNA, 22 nt, Artificial Sequence
  Synthetic Construct
ggaggggucccgcacugggagg

SEQ ID NO: 2013 - RNA, 20 nt, Artificial Sequence
  Synthetic Construct
ccccagggcgacgcggcggg

SEQ ID NO: 2014 - RNA, 21 nt, Artificial Sequence
  Synthetic Construct
cugaccuaugaauugacagcc

SEQ ID NO: 2015 - RNA, 22 nt, Artificial Sequence
  Synthetic Construct
aacuggccuacaaagucccagu

SEQ ID NO: 2016 - RNA, 22 nt, Artificial Sequence
  Synthetic Construct
aacuggcccucaaagucccgcu

SEQ ID NO: 2017 - RNA, 22 nt, Artificial Sequence
  Synthetic Construct
ccaguggggcugcuguuaucug

SEQ ID NO: 2018 - RNA, 22 nt, Artificial Sequence
  Synthetic Construct
ccaauauuggcugugcugcucc

SEQ ID NO: 2019 - RNA, 22 nt, Artificial Sequence
  Synthetic Construct
cggcaacaagaaacugccugag

SEQ ID NO: 2020 - RNA, 22 nt, Artificial Sequence
  Synthetic Construct
uagguaguuuccuguuguuggg

SEQ ID NO: 2021 - RNA, 22 nt, Artificial Sequence
  Synthetic Construct
uucaccaccuucuccacccagc

SEQ ID NO: 2022 - RNA, 22 nt, Artificial Sequence
  Synthetic Construct
agccacugugccuggccugauu

SEQ ID NO: 2023 - RNA, 19 nt, Artificial Sequence
  Synthetic Construct
ugcuaccuuugcacgguuu

SEQ ID NO: 2024 - RNA, 20 nt, Artificial Sequence
  Synthetic Construct
agcaaggagggcaggagguu

SEQ ID NO: 2025 - RNA, 22 nt, Artificial Sequence
  Synthetic Construct
accuaucuccccucuggaccuu

SEQ ID NO: 2026 - RNA, 23 nt, Artificial Sequence
  Synthetic Construct
cccaguguucagacuaccuguuc

SEQ ID NO: 2027 - RNA, 22 nt, Artificial Sequence
  Synthetic Construct
acaguagucugcacauugguua

SEQ ID NO: 2028 - RNA, 22 nt, Artificial Sequence
  Synthetic Construct
aguuuugcauaguugcacuaca

SEQ ID NO: 2029 - RNA, 23 nt, Artificial Sequence
  Synthetic Construct
aguuuugcagguuugcauccagc

SEQ ID NO: 2030 - RNA, 22 nt, Artificial Sequence
  Synthetic Construct
aguuuugcagguuugcauuuca

SEQ ID NO: 2031 - RNA, 22 nt, Artificial Sequence
  Synthetic Construct
caucuuaccggacagugcugga

SEQ ID NO: 2032 - RNA, 22 nt, Artificial Sequence
  Synthetic Construct
uaauacugccugguaaugauga

SEQ ID NO: 2033 - RNA, 22 nt, Artificial Sequence
  Synthetic Construct
cgucuuacccagcaguguuugg

SEQ ID NO: 2034 - RNA, 20 nt, Artificial Sequence
  Synthetic Construct
agagguauagggcaugggaa

SEQ ID NO: 2035 - RNA, 22 nt, Artificial Sequence
  Synthetic Construct
gugaaauguuuaggaccacuag

SEQ ID NO: 2036 - RNA, 23 nt, Artificial Sequence
  Synthetic Construct
uugaacuguuaagaaccacugga

SEQ ID NO: 2037 - RNA, 22 nt, Artificial Sequence
  Synthetic Construct
uucccuuugucauccuaugccu

SEQ ID NO: 2038 - RNA, 21 nt, Artificial Sequence
  Synthetic Construct
gauuucaguggagugaaguuc

SEQ ID NO: 2039 - RNA, 20 nt, Artificial Sequence
  Synthetic Construct
auuacuguuaucaaaacauu

SEQ ID NO: 2040 - RNA, 23 nt, Artificial Sequence
  Synthetic Construct
aaauagagguuuaauuaacacuu

SEQ ID NO: 2041 - RNA, 23 nt, Artificial Sequence
  Synthetic Construct
uaaauuaaauuuauauuacaguu

SEQ ID NO: 2042 - RNA, 22 nt, Artificial Sequence
  Synthetic Construct
acacacuuccuuacauuccauu

SEQ ID NO: 2043 - RNA, 22 nt, Artificial Sequence
  Synthetic Construct
gagcuuuuggcccggguuauac

SEQ ID NO: 2044 - RNA, 22 nt, Artificial Sequence
  Synthetic Construct
auaagacgaacaaaagguuugu

SEQ ID NO: 2045 - RNA, 22 nt, Artificial Sequence
  Synthetic Construct
acugcauuaugagcacuuaaag

SEQ ID NO: 2046 - RNA, 22 nt, Artificial Sequence
  Synthetic Construct
acuguaguaugggcacuuccag

SEQ ID NO: 2047 - RNA, 21 nt, Artificial Sequence
  Synthetic Construct
caacaccagucgaugggcugu

SEQ ID NO: 2048 - RNA, 22 nt, Artificial Sequence
  Synthetic Construct
cugugcgugugacagcggcuga

SEQ ID NO: 2049 - RNA, 22 nt, Artificial Sequence
  Synthetic Construct
uucccuuugucauccuucgccu

SEQ ID NO: 2050 - RNA, 22 nt, Artificial Sequence
  Synthetic Construct
cucagcggccguuuccccaauu

SEQ ID NO: 2051 - RNA, 21 nt, Artificial Sequence
  Synthetic Construct
gacagagccaagcacaaauuu

SEQ ID NO: 2052 - RNA, 21 nt, Artificial Sequence
  Synthetic Construct
cgagccucaagcaagggacuu

SEQ ID NO: 2053 - RNA, 22 nt, Artificial Sequence
  Synthetic Construct
agcuuccaugacuccugaugga

SEQ ID NO: 2054 - RNA, 21 nt, Artificial Sequence
  Synthetic Construct
ccucccaugccaagaacuccc

SEQ ID NO: 2055 - RNA, 21 nt, Artificial Sequence
  Synthetic Construct
guccuuggcaaagagaacauu

SEQ ID NO: 2056 - RNA, 23 nt, Artificial Sequence
  Synthetic Construct
accuuggcucuagacugcuuacu

SEQ ID NO: 2057 - RNA, 22 nt, Artificial Sequence
  Synthetic Construct
acagcaggcacagacaggcagu

SEQ ID NO: 2058 - RNA, 21 nt, Artificial Sequence
  Synthetic Construct
augaccuaugaauugacagac

SEQ ID NO: 2059 - RNA, 22 nt, Artificial Sequence
  Synthetic Construct
ucacaguggucucugggauuau

SEQ ID NO: 2060 - RNA, 24 nt, Artificial Sequence
  Synthetic Construct
acacacuuacccguagagauucua

SEQ ID NO: 2061 - RNA, 23 nt, Artificial Sequence
  Synthetic Construct
caaucaguuccugaugcaguauu

SEQ ID NO: 2062 - RNA, 22 nt, Artificial Sequence
  Synthetic Construct
augguuccgucaagcaccaugg

SEQ ID NO: 2063 - RNA, 22 nt, Artificial Sequence
  Synthetic Construct
caugguucugucaagcaccgcg

SEQ ID NO: 2064 - RNA, 22 nt, Artificial Sequence
  Synthetic Construct
agaguugagucuggacgucccg

SEQ ID NO: 2065 - RNA, 22 nt, Artificial Sequence
  Synthetic Construct
agaauuguggcuggacaucugu

SEQ ID NO: 2066 - RNA, 23 nt, Artificial Sequence
  Synthetic Construct
agaauugcguuuggacaaucagu

SEQ ID NO: 2067 - RNA, 22 nt, Artificial Sequence
  Synthetic Construct
aagcugccaguugaagaacugu

SEQ ID NO: 2068 - RNA, 22 nt, Artificial Sequence
  Synthetic Construct
accuggcauacaauguagauuu

SEQ ID NO: 2069 - RNA, 22 nt, Artificial Sequence
  Synthetic Construct
cucaguagccaguguagauccu

SEQ ID NO: 2070 - RNA, 22 nt, Artificial Sequence
  Synthetic Construct
ugucaguuugucaaauacccca

SEQ ID NO: 2071 - RNA, 21 nt, Artificial Sequence
  Synthetic Construct
caagucacuagugguuccguu

SEQ ID NO: 2072 - RNA, 22 nt, Artificial Sequence
  Synthetic Construct
ucugcaagugucagaggcgagg

SEQ ID NO: 2073 - RNA, 21 nt, Artificial Sequence
  Synthetic Construct
ugacagcgcccugccuggcuc

SEQ ID NO: 2074 - RNA, 22 nt, Artificial Sequence
  Synthetic Construct
aggcaacacacacugcucucuu

SEQ ID NO: 2075 - RNA, 22 nt, Artificial Sequence
  Synthetic Construct
auuguccuugcuguuuggagau

SEQ ID NO: 2076 - RNA, 20 nt, Artificial Sequence
  Synthetic Construct
ccucucacccccauccuauu

SEQ ID NO: 2077 - RNA, 22 nt, Artificial Sequence
  Synthetic Construct
gggguuccuggggaugggauuu

SEQ ID NO: 2078 - RNA, 22 nt, Artificial Sequence
  Synthetic Construct
uggguuccuggcaugcugauuu

SEQ ID NO: 2079 - RNA, 22 nt, Artificial Sequence
  Synthetic Construct
guaaucacuggcaaugugauuu

SEQ ID NO: 2080 - RNA, 22 nt, Artificial Sequence
  Synthetic Construct
ugccuacugagcugauaucagu

SEQ ID NO: 2081 - RNA, 22 nt, Artificial Sequence
  Synthetic Construct
ugccuacugagcugaaacacag

SEQ ID NO: 2082 - RNA, 23 nt, Artificial Sequence
  Synthetic Construct
ugaggcucuguuagccuuggcuc

SEQ ID NO: 2083 - RNA, 22 nt, Artificial Sequence
  Synthetic Construct
cauugcacuugucucggucuga

SEQ ID NO: 2084 - RNA, 22 nt, Artificial Sequence
  Synthetic Construct
uaucauggaguugguaaagcac

SEQ ID NO: 2085 - RNA, 23 nt, Artificial Sequence
  Synthetic Construct
caggcagugacuguucagacguc

SEQ ID NO: 2086 - RNA, 22 nt, Artificial Sequence
  Synthetic Construct
ccuauucuugguuacuugcacg

SEQ ID NO: 2087 - RNA, 22 nt, Artificial Sequence
  Synthetic Construct
ccuauucuugauuacuuguuuc

SEQ ID NO: 2088 - RNA, 22 nt, Artificial Sequence
  Synthetic Construct
ccuguucuccauuacuuggcuc

SEQ ID NO: 2089 - RNA, 22 nt, Artificial Sequence
  Synthetic Construct
agggcuuagcugcuugugagca

SEQ ID NO: 2090 - RNA, 22 nt, Artificial Sequence
  Synthetic Construct
agagcuuagcugauuggugaac

SEQ ID NO: 2091 - RNA, 22 nt, Artificial Sequence
  Synthetic Construct
aaggagcucacagucuauugag

SEQ ID NO: 2092 - RNA, 19 nt, Artificial Sequence
  Synthetic Construct
gcccaccgccaggccccuu

SEQ ID NO: 2093 - RNA, 21 nt, Artificial Sequence
  Synthetic Construct
aagagauguuggcccuaacuu

SEQ ID NO: 2094 - RNA, 21 nt, Artificial Sequence
  Synthetic Construct
agggcccccccucaauccugu

SEQ ID NO: 2095 - RNA, 21 nt, Artificial Sequence
  Synthetic Construct
ugcacaugcacacauacauuu

SEQ ID NO: 2096 - RNA, 24 nt, Artificial Sequence
  Synthetic Construct
ggagaaccucccugcuucugcuuu

SEQ ID NO: 2097 - RNA, 22 nt, Artificial Sequence
  Synthetic Construct
uaugugggaugguaaaccgcuu

SEQ ID NO: 2098 - RNA, 22 nt, Artificial Sequence
  Synthetic Construct
uagcaccaucugaaaucgguua

SEQ ID NO: 2099 - RNA, 24 nt, Artificial Sequence
  Synthetic Construct
gcugguuucauauggugguuuaga

SEQ ID NO: 2100 - RNA, 22 nt, Artificial Sequence
  Synthetic Construct
cugguuucacaugguggcuuag

SEQ ID NO: 2101 - RNA, 22 nt, Artificial Sequence
  Synthetic Construct
uagcaccauuugaaaucgguua

SEQ ID NO: 2102 - RNA, 22 nt, Artificial Sequence
  Synthetic Construct
agagagucugcccuuguauauu

SEQ ID NO: 2103 - RNA, 23 nt, Artificial Sequence
  Synthetic Construct
cagugcaauaguauugucaaagc

SEQ ID NO: 2104 - RNA, 22 nt, Artificial Sequence
  Synthetic Construct
gcucugacgagguugcacuacu

SEQ ID NO: 2105 - RNA, 23 nt, Artificial Sequence
  Synthetic Construct
acuuaaacguggauguacuugcu

SEQ ID NO: 2106 - RNA, 22 nt, Artificial Sequence
  Synthetic Construct
acuuuaacauggaagugcuuuc

SEQ ID NO: 2107 - RNA, 23 nt, Artificial Sequence
  Synthetic Construct
uaagugcuuccauguuucagugg

SEQ ID NO: 2108 - RNA, 23 nt, Artificial Sequence
  Synthetic Construct
uaagugcuuccauguuugagugu

SEQ ID NO: 2109 - RNA, 17 nt, Artificial Sequence
  Synthetic Construct
gcauggaagcacuuauu

SEQ ID NO: 2110 - RNA, 17 nt, Artificial Sequence
  Synthetic Construct
acauggaagcaauuauu

SEQ ID NO: 2111 - RNA, 21 nt, Artificial Sequence
  Synthetic Construct
ucuggcuguuguggugugcaa

SEQ ID NO: 2112 - RNA, 23 nt, Artificial Sequence
  Synthetic Construct
ucaacaaaaucacugaugcugga

SEQ ID NO: 2113 - RNA, 21 nt, Artificial Sequence
  Synthetic Construct
guuccugcugaacugagccag

SEQ ID NO: 2114 - RNA, 22 nt, Artificial Sequence
  Synthetic Construct
uguaaacauccucgacuggaag

SEQ ID NO: 2115 - RNA, 22 nt, Artificial Sequence
  Synthetic Construct
cugggagguggauguuuacuuc

SEQ ID NO: 2116 - RNA, 22 nt, Artificial Sequence
  Synthetic Construct
cugggagaggguuguuuacucc

SEQ ID NO: 2117 - RNA, 22 nt, Artificial Sequence
  Synthetic Construct
cugggagaaggcuguuuacucu

SEQ ID NO: 2118 - RNA, 22 nt, Artificial Sequence
  Synthetic Construct
cuuucagucagauguuugcugc

SEQ ID NO: 2119 - RNA, 22 nt, Artificial Sequence
  Synthetic Construct
cuuucagucggauguuuacagc

SEQ ID NO: 2120 - RNA, 21 nt, Artificial Sequence
  Synthetic Construct
aggcaagaugcuggcauagcu

SEQ ID NO: 2121 - RNA, 20 nt, Artificial Sequence
  Synthetic Construct
caacuaguaaacccauauuu

SEQ ID NO: 2122 - RNA, 22 nt, Artificial Sequence
  Synthetic Construct
ucccuacuauguuccaggcauu

SEQ ID NO: 2123 - RNA, 20 nt, Artificial Sequence
  Synthetic Construct
agacacuauacgagucauau

SEQ ID NO: 2124 - RNA, 23 nt, Artificial Sequence
  Synthetic Construct
aauuuucauaaugcagucacauu

SEQ ID NO: 2125 - RNA, 20 nt, Artificial Sequence
  Synthetic Construct
caucaaaguuaaaagccauu

SEQ ID NO: 2126 - RNA, 21 nt, Artificial Sequence
  Synthetic Construct
cacagcaaguguagacaggca

SEQ ID NO: 2127 - RNA, 22 nt, Artificial Sequence
  Synthetic Construct
uaaauagaguaggcaaaggaca

SEQ ID NO: 2128 - RNA, 22 nt, Artificial Sequence
  Synthetic Construct
gaccguccucuugucccaacuu

SEQ ID NO: 2129 - RNA, 17 nt, Artificial Sequence
  Synthetic Construct
uuaaacaauucucuguu

SEQ ID NO: 2130 - RNA, 22 nt, Artificial Sequence
  Synthetic Construct
acuuuccucacucccgugaagu

SEQ ID NO: 2131 - RNA, 20 nt, Artificial Sequence
  Synthetic Construct
ucuccacagcuuccucuauu

SEQ ID NO: 2132 - RNA, 22 nt, Artificial Sequence
  Synthetic Construct
ugagggacagaugccagaagca

SEQ ID NO: 2133 - RNA, 23 nt, Artificial Sequence
  Synthetic Construct
aucagggcuuguggaaugggaag

SEQ ID NO: 2134 - RNA, 23 nt, Artificial Sequence
  Synthetic Construct
gagaguuuuuuacuugccagauu

SEQ ID NO: 2135 - RNA, 22 nt, Artificial Sequence
  Synthetic Construct
aaacuaaucucuacacugcugc

SEQ ID NO: 2136 - RNA, 21 nt, Artificial Sequence
  Synthetic Construct
uacccagucuccggugcagcc

SEQ ID NO: 2137 - RNA, 23 nt, Artificial Sequence
  Synthetic Construct
ggcccuuccaccaguccucgauu

SEQ ID NO: 2138 - RNA, 24 nt, Artificial Sequence
  Synthetic Construct
cucugagcuccuucucuacccauu

SEQ ID NO: 2139 - RNA, 22 nt, Artificial Sequence
  Synthetic Construct
uggguuuuaagaguucuuuauu

SEQ ID NO: 2140 - RNA, 23 nt, Artificial Sequence
  Synthetic Construct
uauguagucuuuuauccaucauu

SEQ ID NO: 2141 - RNA, 22 nt, Artificial Sequence
  Synthetic Construct
cugcagucucagccuaggcauu

SEQ ID NO: 2142 - RNA, 22 nt, Artificial Sequence
  Synthetic Construct
ccacugcacucgcuccagccuu

SEQ ID NO: 2143 - RNA, 22 nt, Artificial Sequence
  Synthetic Construct
uggcccaaccuauucaguuagu

SEQ ID NO: 2144 - RNA, 24 nt, Artificial Sequence
  Synthetic Construct
cccauugcucccaggcuacagauu

SEQ ID NO: 2145 - RNA, 24 nt, Artificial Sequence
  Synthetic Construct
ucccucuaccucacuguccacauu

SEQ ID NO: 2146 - RNA, 23 nt, Artificial Sequence
  Synthetic Construct
caggcaucuguugagcuccuauu

SEQ ID NO: 2147 - RNA, 22 nt, Artificial Sequence
  Synthetic Construct
agcuuuugggaauucagguagu

SEQ ID NO: 2148 - RNA, 19 nt, Artificial Sequence
  Synthetic Construct
cuccuccacccgcccucuu

SEQ ID NO: 2149 - RNA, 22 nt, Artificial Sequence
  Synthetic Construct
ugaagguucagaaaggccuuuu

SEQ ID NO: 2150 - RNA, 25 nt, Artificial Sequence
  Synthetic Construct
aaagaagcgcuuuacaauguuauuu

SEQ ID NO: 2151 - RNA, 22 nt, Artificial Sequence
  Synthetic Construct
aggggaccaaagagauauauag

SEQ ID NO: 2152 - RNA, 22 nt, Artificial Sequence
  Synthetic Construct
aacuccaaacacucaaaacuca

SEQ ID NO: 2153 - RNA, 22 nt, Artificial Sequence
  Synthetic Construct
auucuuucuauccuagcauguu

SEQ ID NO: 2154 - RNA, 24 nt, Artificial Sequence
  Synthetic Construct
acacccuccucacugcccaaccuu

SEQ ID NO: 2155 - RNA, 22 nt, Artificial Sequence
  Synthetic Construct
gcacacaccaguuuuuuccauu

SEQ ID NO: 2156 - RNA, 23 nt, Artificial Sequence
  Synthetic Construct
acacacacauauccauacaaauu

SEQ ID NO: 2157 - RNA, 22 nt, Artificial Sequence
  Synthetic Construct
cuggggagauccucgagguugg

SEQ ID NO: 2158 - RNA, 21 nt, Artificial Sequence
  Synthetic Construct
ugaggagaucgucgagguugg

SEQ ID NO: 2159 - RNA, 20 nt, Artificial Sequence
  Synthetic Construct
ccugaucccacagcccaccu

SEQ ID NO: 2160 - RNA, 22 nt, Artificial Sequence
  Synthetic Construct
uguguuagaauaggggcaauaa

SEQ ID NO: 2161 - RNA, 23 nt, Artificial Sequence
  Synthetic Construct
augucccuacucgcuuuccccuu

SEQ ID NO: 2162 - RNA, 22 nt, Artificial Sequence
  Synthetic Construct
ugcucccaacuccccuucuguu

SEQ ID NO: 2163 - RNA, 21 nt, Artificial Sequence
  Synthetic Construct
uucccacugcagagccugguu

SEQ ID NO: 2164 - RNA, 18 nt, Artificial Sequence
  Synthetic Construct
ccacugcagagccugguu

SEQ ID NO: 2165 - RNA, 22 nt, Artificial Sequence
  Synthetic Construct
aaagaucuggaagugggagaca

SEQ ID NO: 2166 - RNA, 22 nt, Artificial Sequence
  Synthetic Construct
uucagccaggcuagugcagucu

SEQ ID NO: 2167 - RNA, 21 nt, Artificial Sequence
  Synthetic Construct
ccugcagagaggaagcccuuc

SEQ ID NO: 2168 - RNA, 22 nt, Artificial Sequence
  Synthetic Construct
ggccgacacuuguaauccuauu

SEQ ID NO: 2169 - RNA, 22 nt, Artificial Sequence
  Synthetic Construct
ggcuuucuagucucagcucucc

SEQ ID NO: 2170 - RNA, 23 nt, Artificial Sequence
  Synthetic Construct
cugggccucuguucuuaucaguu

SEQ ID NO: 2171 - RNA, 21 nt, Artificial Sequence
  Synthetic Construct
ucccuaccccuccacucccca

SEQ ID NO: 2172 - RNA, 22 nt, Artificial Sequence
  Synthetic Construct
cuuacugcccucauuuuauauu

SEQ ID NO: 2173 - RNA, 22 nt, Artificial Sequence
  Synthetic Construct
ccauuucccuuaaagucacauu

SEQ ID NO: 2174 - RNA, 22 nt, Artificial Sequence
  Synthetic Construct
aggucacauugcauccaccuuu

SEQ ID NO: 2175 - RNA, 23 nt, Artificial Sequence
  Synthetic Construct
ggccaguaggcauugucugcguu

SEQ ID NO: 2176 - RNA, 22 nt, Artificial Sequence
  Synthetic Construct
accaguauuucugaaauccuuu

SEQ ID NO: 2177 - RNA, 17 nt, Artificial Sequence
  Synthetic Construct
cugacuguagaacucuu

SEQ ID NO: 2178 - RNA, 22 nt, Artificial Sequence
  Synthetic Construct
augugccaagcacaguccuauu

SEQ ID NO: 2179 - RNA, 22 nt, Artificial Sequence
  Synthetic Construct
ugucugucucagaaccccaguu

SEQ ID NO: 2180 - RNA, 24 nt, Artificial Sequence
  Synthetic Construct
uauauacagauuccauacaucuuu

SEQ ID NO: 2181 - RNA, 22 nt, Artificial Sequence
  Synthetic Construct
ugcccugccuguuuucuccuuu

SEQ ID NO: 2182 - RNA, 23 nt, Artificial Sequence
  Synthetic Construct
cucugcaucucuaacucacuauu

SEQ ID NO: 2183 - RNA, 22 nt, Artificial Sequence
  Synthetic Construct
gucacugcguucucuccccguu

SEQ ID NO: 2184 - RNA, 19 nt, Artificial Sequence
  Synthetic Construct
gguagucccaggccaguuu

SEQ ID NO: 2185 - RNA, 21 nt, Artificial Sequence
  Synthetic Construct
ugcacggcacuggggacacgu

SEQ ID NO: 2186 - RNA, 17 nt, Artificial Sequence
  Synthetic Construct
auccggccgcgccccuu

SEQ ID NO: 2187 - RNA, 22 nt, Artificial Sequence
  Synthetic Construct
guuuaaauuucaccccuucuuu

SEQ ID NO: 2188 - RNA, 22 nt, Artificial Sequence
  Synthetic Construct
uggggcggagcuuccggaggcc

SEQ ID NO: 2189 - RNA, 19 nt, Artificial Sequence
  Synthetic Construct
ggcgccgagggcccgauuu

SEQ ID NO: 2190 - RNA, 17 nt, Artificial Sequence
  Synthetic Construct
cuacacuacagaagcuu

SEQ ID NO: 2191 - RNA, 22 nt, Artificial Sequence
  Synthetic Construct
cgagcgacuccgagagaggcuu

SEQ ID NO: 2192 - RNA, 24 nt, Artificial Sequence
  Synthetic Construct
ugaggggccucagaccgagcuuuu

SEQ ID NO: 2193 - RNA, 23 nt, Artificial Sequence
  Synthetic Construct
gcagaccgaccgccuucuucuuu

SEQ ID NO: 2194 - RNA, 21 nt, Artificial Sequence
  Synthetic Construct
ucacgcggagagauggcuuug

SEQ ID NO: 2195 - RNA, 23 nt, Artificial Sequence
  Synthetic Construct
ccugggcagcguguggcugaagg

SEQ ID NO: 2196 - RNA, 23 nt, Artificial Sequence
  Synthetic Construct
ccguauccgcacaaagccucuuu

SEQ ID NO: 2197 - RNA, 25 nt, Artificial Sequence
  Synthetic Construct
ugccccaucugugcccuggguagga

SEQ ID NO: 2198 - RNA, 20 nt, Artificial Sequence
  Synthetic Construct
ucuggccagcuacgucccca

SEQ ID NO: 2199 - RNA, 23 nt, Artificial Sequence
  Synthetic Construct
uggggacguagcuggccagacag

SEQ ID NO: 2200 - RNA, 21 nt, Artificial Sequence
  Synthetic Construct
cucugaucgcccucucagcuc

SEQ ID NO: 2201 - RNA, 22 nt, Artificial Sequence
  Synthetic Construct
uccucagauccuacgcaggauu

SEQ ID NO: 2202 - RNA, 21 nt, Artificial Sequence
  Synthetic Construct
ggccagccaccaggagggcug

SEQ ID NO: 2203 - RNA, 17 nt, Artificial Sequence
  Synthetic Construct
cccgggcccggcgcguu

SEQ ID NO: 2204 - RNA, 18 nt, Artificial Sequence
  Synthetic Construct
ggccccugccgccccguu

SEQ ID NO: 2205 - RNA, 23 nt, Artificial Sequence
  Synthetic Construct
ccuuuccgagccugcgccuccuu

SEQ ID NO: 2206 - RNA, 22 nt, Artificial Sequence
  Synthetic Construct
uccauuccccaggacuccacuu

SEQ ID NO: 2207 - RNA, 23 nt, Artificial Sequence
  Synthetic Construct
cuuucuccuaaggcagucccuuu

SEQ ID NO: 2208 - RNA, 22 nt, Artificial Sequence
  Synthetic Construct
uauugcacauuacuaaguugca

SEQ ID NO: 2209 - RNA, 22 nt, Artificial Sequence
  Synthetic Construct
aaucugagaaggcgcacaaggu

SEQ ID NO: 2210 - RNA, 17 nt, Artificial Sequence
  Synthetic Construct
uuuucuucauaucccuu

SEQ ID NO: 2211 - RNA, 22 nt, Artificial Sequence
  Synthetic Construct
uaaagcucuucucccuuccauu

SEQ ID NO: 2212 - RNA, 22 nt, Artificial Sequence
  Synthetic Construct
gcccucucaacccagcuuuuuu

SEQ ID NO: 2213 - RNA, 22 nt, Artificial Sequence
  Synthetic Construct
gcccucucaacccagcuuuuuu

SEQ ID NO: 2214 - RNA, 20 nt, Artificial Sequence
  Synthetic Construct
ccucucaacccagcuuuuuu

SEQ ID NO: 2215 - RNA, 19 nt, Artificial Sequence
  Synthetic Construct
cucucaacccagcuuuuuu

SEQ ID NO: 2216 - RNA, 18 nt, Artificial Sequence
  Synthetic Construct
uucucaacccagcuuuuu

SEQ ID NO: 2217 - RNA, 21 nt, Artificial Sequence
  Synthetic Construct
cacauuacacggucgaccucu

SEQ ID NO: 2218 - RNA, 22 nt, Artificial Sequence
  Synthetic Construct
cccaauacacggucgaccucuu

SEQ ID NO: 2219 - RNA, 20 nt, Artificial Sequence
  Synthetic Construct
acugccccaggugcugcugg

SEQ ID NO: 2220 - RNA, 23 nt, Artificial Sequence
  Synthetic Construct
acuuacuggacaccuacuagguu

SEQ ID NO: 2221 - RNA, 20 nt, Artificial Sequence
  Synthetic Construct
ggaggaagggcccagagguu

SEQ ID NO: 2222 - RNA, 23 nt, Artificial Sequence
  Synthetic Construct
gggggggcaggaggggcucaggg

SEQ ID NO: 2223 - RNA, 23 nt, Artificial Sequence
  Synthetic Construct
gagguuuucuggguuucuguuuc

SEQ ID NO: 2224 - RNA, 22 nt, Artificial Sequence
  Synthetic Construct
ucucugggccugugucuuaggc

SEQ ID NO: 2225 - RNA, 21 nt, Artificial Sequence
  Synthetic Construct
gccccugggccuauccuagaa

SEQ ID NO: 2226 - RNA, 22 nt, Artificial Sequence
  Synthetic Construct
uuuuucauuauugcuccugacc

SEQ ID NO: 2227 - RNA, 22 nt, Artificial Sequence
  Synthetic Construct
cuccuauaugaugccuuucuuc

SEQ ID NO: 2228 - RNA, 22 nt, Artificial Sequence
  Synthetic Construct
aacaauauccuggugcugagug

SEQ ID NO: 2229 - RNA, 23 nt, Artificial Sequence
  Synthetic Construct
ucccuguccuccaggagcucacg

SEQ ID NO: 2230 - RNA, 22 nt, Artificial Sequence
  Synthetic Construct
caauguuuccacagugcaucac

SEQ ID NO: 2231 - RNA, 22 nt, Artificial Sequence
  Synthetic Construct
cagugccucggcagugcagccc

SEQ ID NO: 2232 - RNA, 22 nt, Artificial Sequence
  Synthetic Construct
uuauaaagcaaugagacugauu

SEQ ID NO: 2233 - RNA, 21 nt, Artificial Sequence
  Synthetic Construct
aggggugcuaucugugauuga

SEQ ID NO: 2234 - RNA, 22 nt, Artificial Sequence
  Synthetic Construct
gcugacuccuaguccagggcuc

SEQ ID NO: 2235 - RNA, 23 nt, Artificial Sequence
  Synthetic Construct
aggcaggcaugcgggcagacauu

SEQ ID NO: 2236 - RNA, 22 nt, Artificial Sequence
  Synthetic Construct
caaucagcaaguauacugcccu

SEQ ID NO: 2237 - RNA, 22 nt, Artificial Sequence
  Synthetic Construct
caaucacuaacuccacugccau

SEQ ID NO: 2238 - RNA, 23 nt, Artificial Sequence
  Synthetic Construct
aggcaguguaguuagcugauugc

SEQ ID NO: 2239 - RNA, 22 nt, Artificial Sequence
  Synthetic Construct
agguagacugggauuuguuguu

SEQ ID NO: 2240 - RNA, 23 nt, Artificial Sequence
  Synthetic Construct
uuuagugugauaauggcguuuga

SEQ ID NO: 2241 - RNA, 23 nt, Artificial Sequence
  Synthetic Construct
ugaggauggauagcaaggaagcc

SEQ ID NO: 2242 - RNA, 21 nt, Artificial Sequence
  Synthetic Construct
aaaauuucuuucacuacuuag

SEQ ID NO: 2243 - RNA, 22 nt, Artificial Sequence
  Synthetic Construct
gcaugugaugaagcaaaucagu

SEQ ID NO: 2244 - RNA, 24 nt, Artificial Sequence
  Synthetic Construct
gccaguauuacucaucacuuuguu

SEQ ID NO: 2245 - RNA, 22 nt, Artificial Sequence
  Synthetic Construct
uuaucagaaucuccagggguac

SEQ ID NO: 2246 - RNA, 20 nt, Artificial Sequence
  Synthetic Construct
gcgccuccuuuccgauucuu

SEQ ID NO: 2247 - RNA, 21 nt, Artificial Sequence
  Synthetic Construct
agaauuucuuucuucacaauu

SEQ ID NO: 2248 - RNA, 22 nt, Artificial Sequence
  Synthetic Construct
cauuucucaagaugccuccuuu

SEQ ID NO: 2249 - RNA, 24 nt, Artificial Sequence
  Synthetic Construct
acaaaaaaaaaagcccaacccuuc

SEQ ID NO: 2250 - RNA, 23 nt, Artificial Sequence
  Synthetic Construct
uagccuucagaucuugguguuuu

SEQ ID NO: 2251 - RNA, 21 nt, Artificial Sequence
  Synthetic Construct
gccgcgaggagccgagagauu

SEQ ID NO: 2252 - RNA, 23 nt, Artificial Sequence
  Synthetic Construct
cgagggcauuucaugaugcaggc

SEQ ID NO: 2253 - RNA, 22 nt, Artificial Sequence
  Synthetic Construct
aaagacauaguugcaagauggg

SEQ ID NO: 2254 - RNA, 22 nt, Artificial Sequence
  Synthetic Construct
ucuuuucauuaauguagacauu

SEQ ID NO: 2255 - RNA, 22 nt, Artificial Sequence
  Synthetic Construct
gggaccauccugccugcugugg

SEQ ID NO: 2256 - RNA, 24 nt, Artificial Sequence
  Synthetic Construct
aauccuuggaaccuaggugugagu

SEQ ID NO: 2257 - RNA, 22 nt, Artificial Sequence
  Synthetic Construct
gugggcugggcugggcugggcc

SEQ ID NO: 2258 - RNA, 20 nt, Artificial Sequence
  Synthetic Construct
ugcagaccccgacccgcguu

SEQ ID NO: 2259 - RNA, 22 nt, Artificial Sequence
  Synthetic Construct
caggcacgggagcucaggugag

SEQ ID NO: 2260 - RNA, 20 nt, Artificial Sequence
  Synthetic Construct
aggcaugggaggucagguga

SEQ ID NO: 2261 - RNA, 22 nt, Artificial Sequence
  Synthetic Construct
cggguggaucacgaugcaauuu

SEQ ID NO: 2262 - RNA, 22 nt, Artificial Sequence
  Synthetic Construct
ggcugggcucauuucauuuuuu

SEQ ID NO: 2263 - RNA, 21 nt, Artificial Sequence
  Synthetic Construct
cucggcgauccccgcggcuuu

SEQ ID NO: 2264 - RNA, 19 nt, Artificial Sequence
  Synthetic Construct
uagacacucaggucccuuu

SEQ ID NO: 2265 - RNA, 19 nt, Artificial Sequence
  Synthetic Construct
acucuacagacacaccuuu

SEQ ID NO: 2266 - RNA, 24 nt, Artificial Sequence
  Synthetic Construct
auguaccagcgaccgggcuauguu

SEQ ID NO: 2267 - RNA, 18 nt, Artificial Sequence
  Synthetic Construct
cucacaccuccagccguu

SEQ ID NO: 2268 - RNA, 18 nt, Artificial Sequence
  Synthetic Construct
cuaagaaguugacugaag

SEQ ID NO: 2269 - RNA, 19 nt, Artificial Sequence
  Synthetic Construct
ccucagcuuguccagucuu

SEQ ID NO: 2270 - RNA, 21 nt, Artificial Sequence
  Synthetic Construct
caacaccgcagcgacaagcuu

SEQ ID NO: 2271 - RNA, 17 nt, Artificial Sequence
  Synthetic Construct
acccccgcacccgccuu

SEQ ID NO: 2272 - RNA, 21 nt, Artificial Sequence
  Synthetic Construct
ucaccaauaaugggacacauu

SEQ ID NO: 2273 - RNA, 22 nt, Artificial Sequence
  Synthetic Construct
cuccaugguguuuucuuaaauu

SEQ ID NO: 2274 - RNA, 21 nt, Artificial Sequence
  Synthetic Construct
cccucguagacaacacucauu

SEQ ID NO: 2275 - RNA, 23 nt, Artificial Sequence
  Synthetic Construct
agggacuuuugggggcagaugug

SEQ ID NO: 2276 - RNA, 22 nt, Artificial Sequence
  Synthetic Construct
agggacuuucaggggcagcugu

SEQ ID NO: 2277 - RNA, 21 nt, Artificial Sequence
  Synthetic Construct
aaaaugcucuccugucaguuu

SEQ ID NO: 2278 - RNA, 22 nt, Artificial Sequence
  Synthetic Construct
gcuguccgagucccaggucauu

SEQ ID NO: 2279 - RNA, 24 nt, Artificial Sequence
  Synthetic Construct
ucagucacuacucaucauuuucuu

SEQ ID NO: 2280 - RNA, 21 nt, Artificial Sequence
  Synthetic Construct
gcuggucugcguggugcucgg

SEQ ID NO: 2281 - RNA, 22 nt, Artificial Sequence
  Synthetic Construct
aacucugucuucacucaugagu

SEQ ID NO: 2282 - RNA, 18 nt, Artificial Sequence
  Synthetic Construct
ccgccccgcaccugcuuu

SEQ ID NO: 2283 - RNA, 21 nt, Artificial Sequence
  Synthetic Construct
ggcaucuacacuugcacuguu

SEQ ID NO: 2284 - RNA, 22 nt, Artificial Sequence
  Synthetic Construct
aaagacccauugaggagaaggu

SEQ ID NO: 2285 - RNA, 21 nt, Artificial Sequence
  Synthetic Construct
uuugaucaaucucuacauuuu

SEQ ID NO: 2286 - RNA, 22 nt, Artificial Sequence
  Synthetic Construct
acuguugcuaauaugcaacucu

SEQ ID NO: 2287 - RNA, 24 nt, Artificial Sequence
  Synthetic Construct
gagaaggacagcugugagcucuuu

SEQ ID NO: 2288 - RNA, 22 nt, Artificial Sequence
  Synthetic Construct
cagacuaguccuuauuugauuu

SEQ ID NO: 2289 - RNA, 23 nt, Artificial Sequence
  Synthetic Construct
gauguuuuacaugagucucauuu

SEQ ID NO: 2290 - RNA, 22 nt, Artificial Sequence
  Synthetic Construct
ccaaucuuagguucuacaauuu

SEQ ID NO: 2291 - RNA, 23 nt, Artificial Sequence
  Synthetic Construct
uauggggcuucuguagagauuuc

SEQ ID NO: 2292 - RNA, 22 nt, Artificial Sequence
  Synthetic Construct
cucgugggcucuggccacggcc

SEQ ID NO: 2293 - RNA, 20 nt, Artificial Sequence
  Synthetic Construct
uccguacaaacucugcugug

SEQ ID NO: 2294 - RNA, 23 nt, Artificial Sequence
  Synthetic Construct
ugaggauauggcagggaagggga

SEQ ID NO: 2295 - RNA, 23 nt, Artificial Sequence
  Synthetic Construct
uuuugcaugacccugggaguagg

SEQ ID NO: 2296 - RNA, 22 nt, Artificial Sequence
  Synthetic Construct
acacagugcuucauccacuacu

SEQ ID NO: 2297 - RNA, 21 nt, Artificial Sequence
  Synthetic Construct
ugaugauacagguggagguag

SEQ ID NO: 2298 - RNA, 22 nt, Artificial Sequence
  Synthetic Construct
auacuacuuccaaugucgcauu

SEQ ID NO: 2299 - RNA, 21 nt, Artificial Sequence
  Synthetic Construct
ggacguguacuaggucuaauu

SEQ ID NO: 2300 - RNA, 22 nt, Artificial Sequence
  Synthetic Construct
ucuucagguaggguaggaaauu

SEQ ID NO: 2301 - RNA, 22 nt, Artificial Sequence
  Synthetic Construct
auuuacuuucucuuacagauuu

SEQ ID NO: 2302 - RNA, 24 nt, Artificial Sequence
  Synthetic Construct
gucgcacgaacgccuguccggguu

SEQ ID NO: 2303 - RNA, 21 nt, Artificial Sequence
  Synthetic Construct
aguggcaaagucuuuccauau

SEQ ID NO: 2304 - RNA, 22 nt, Artificial Sequence
  Synthetic Construct
ugugauaucaugguuccuggga

SEQ ID NO: 2305 - RNA, 22 nt, Artificial Sequence
  Synthetic Construct
ugugauaucaugguuccuggga

SEQ ID NO: 2306 - RNA, 22 nt, Artificial Sequence
  Synthetic Construct
cacaauaucacaccucccaguu

SEQ ID NO: 2307 - RNA, 22 nt, Artificial Sequence
  Synthetic Construct
agugugagaucacaccucccuu

SEQ ID NO: 2308 - RNA, 22 nt, Artificial Sequence
  Synthetic Construct
ccaggaaccaugauaucacauu

SEQ ID NO: 2309 - RNA, 22 nt, Artificial Sequence
  Synthetic Construct
ccaggaagcacgauaucacauu

SEQ ID NO: 2310 - RNA, 22 nt, Artificial Sequence
  Synthetic Construct
agaucgaccguguuauauucgc

SEQ ID NO: 2311 - RNA, 23 nt, Artificial Sequence
  Synthetic Construct
uugucuacgcuggguccagguuu

SEQ ID NO: 2312 - RNA, 22 nt, Artificial Sequence
  Synthetic Construct
accaagucugcgucauccucuc

SEQ ID NO: 2313 - RNA, 24 nt, Artificial Sequence
  Synthetic Construct
ccugcuggucaggaguggauacug

SEQ ID NO: 2314 - RNA, 22 nt, Artificial Sequence
  Synthetic Construct
caggucacgucucugcaguuac

SEQ ID NO: 2315 - RNA, 20 nt, Artificial Sequence
  Synthetic Construct
cauccccaaacggauaccuu

SEQ ID NO: 2316 - RNA, 22 nt, Artificial Sequence
  Synthetic Construct
aggggagcacugcugccuucuu

SEQ ID NO: 2317 - RNA, 23 nt, Artificial Sequence
  Synthetic Construct
aagugccgccaucuuuugagugu

SEQ ID NO: 2318 - RNA, 23 nt, Artificial Sequence
  Synthetic Construct
aagugcccccacaguuugagugc

SEQ ID NO: 2319 - RNA, 23 nt, Artificial Sequence
  Synthetic Construct
aaagugcugcgacauuugagcgu

SEQ ID NO: 2320 - RNA, 22 nt, Artificial Sequence
  Synthetic Construct
acucaaaaugggggcgcuuucc

SEQ ID NO: 2321 - RNA, 22 nt, Artificial Sequence
  Synthetic Construct
cuuaucagauuguauuguaauu

SEQ ID NO: 2322 - RNA, 22 nt, Artificial Sequence
  Synthetic Construct
auauaauacaaccugcuaagug

SEQ ID NO: 2323 - RNA, 22 nt, Artificial Sequence
  Synthetic Construct
auaauacaaccugcuaagugcu

SEQ ID NO: 2324 - RNA, 22 nt, Artificial Sequence
  Synthetic Construct
acgcgagccgaacgaacaaauu

SEQ ID NO: 2325 - RNA, 22 nt, Artificial Sequence
  Synthetic Construct
guagauucuccuucuaugagua

SEQ ID NO: 2326 - RNA, 21 nt, Artificial Sequence
  Synthetic Construct
gguagauuuuccuucuauggu

SEQ ID NO: 2327 - RNA, 22 nt, Artificial Sequence
  Synthetic Construct
aucauagaggaaaauccauguu

SEQ ID NO: 2328 - RNA, 21 nt, Artificial Sequence
  Synthetic Construct
aacauagaggaaauuccacgu

SEQ ID NO: 2329 - RNA, 22 nt, Artificial Sequence
  Synthetic Construct
aucacacaaaggcaacuuuugu

SEQ ID NO: 2330 - RNA, 22 nt, Artificial Sequence
  Synthetic Construct
acuggacuuggagucagaaggc

SEQ ID NO: 2331 - RNA, 19 nt, Artificial Sequence
  Synthetic Construct
cugccuccaaguccaguuu

SEQ ID NO: 2332 - RNA, 25 nt, Artificial Sequence
  Synthetic Construct
acucuucugacuccaaguccaguuu

SEQ ID NO: 2333 - RNA, 20 nt, Artificial Sequence
  Synthetic Construct
ucugacuccaaguccaguuu

SEQ ID NO: 2334 - RNA, 19 nt, Artificial Sequence
  Synthetic Construct
cugacuccaaguccaguuu

SEQ ID NO: 2335 - RNA, 20 nt, Artificial Sequence
  Synthetic Construct
ucuggcuccaaguccaguuu

SEQ ID NO: 2336 - RNA, 20 nt, Artificial Sequence
  Synthetic Construct
ucugacuccaagcccaguuu

SEQ ID NO: 2337 - RNA, 21 nt, Artificial Sequence
  Synthetic Construct
aucugacaccaaguccaguuu

SEQ ID NO: 2338 - RNA, 21 nt, Artificial Sequence
  Synthetic Construct
uucugacuccuaguccaguuu

SEQ ID NO: 2339 - RNA, 19 nt, Artificial Sequence
  Synthetic Construct
cuggcuccaaauccaguuu

SEQ ID NO: 2340 - RNA, 22 nt, Artificial Sequence
  Synthetic Construct
uauguaacaugguccacuaacu

SEQ ID NO: 2341 - RNA, 22 nt, Artificial Sequence
  Synthetic Construct
uauguaauaugguccacaucuu

SEQ ID NO: 2342 - RNA, 22 nt, Artificial Sequence
  Synthetic Construct
uauacaagggcaagcucucugu

SEQ ID NO: 2343 - RNA, 22 nt, Artificial Sequence
  Synthetic Construct
gaaguuguucgugguggauucg

SEQ ID NO: 2344 - RNA, 22 nt, Artificial Sequence
  Synthetic Construct
agaucagaaggugauuguggcu

SEQ ID NO: 2345 - RNA, 20 nt, Artificial Sequence
  Synthetic Construct
ugaacaauuucuaggaauuu

SEQ ID NO: 2346 - RNA, 22 nt, Artificial Sequence
  Synthetic Construct
ugagccagccuggagcaccuuu

SEQ ID NO: 2347 - RNA, 22 nt, Artificial Sequence
  Synthetic Construct
acagucuaccuacauugcucuu

SEQ ID NO: 2348 - RNA, 22 nt, Artificial Sequence
  Synthetic Construct
acugcaggcccuagaggacauu

SEQ ID NO: 2349 - RNA, 20 nt, Artificial Sequence
  Synthetic Construct
ucuugguuuuaugccuuuuu

SEQ ID NO: 2350 - RNA, 22 nt, Artificial Sequence
  Synthetic Construct
ccuccuccaggauccacacauu

SEQ ID NO: 2351 - RNA, 21 nt, Artificial Sequence
  Synthetic Construct
auguccauauuauggguuagu

SEQ ID NO: 2352 - RNA, 22 nt, Artificial Sequence
  Synthetic Construct
agacaucaagaucagucccaaa

SEQ ID NO: 2353 - RNA, 22 nt, Artificial Sequence
  Synthetic Construct
uucucauuuucugguuccuuuu

SEQ ID NO: 2354 - RNA, 22 nt, Artificial Sequence
  Synthetic Construct
uaagaccaucuuuuccucaauu

SEQ ID NO: 2355 - RNA, 26 nt, Artificial Sequence
  Synthetic Construct
gagaaccagccauuucuuccucuuuu

SEQ ID NO: 2356 - RNA, 20 nt, Artificial Sequence
  Synthetic Construct
caccugcucaguccgagcuu

SEQ ID NO: 2357 - RNA, 21 nt, Artificial Sequence
  Synthetic Construct
ucuccaucugcggcccuguuu

SEQ ID NO: 2358 - RNA, 21 nt, Artificial Sequence
  Synthetic Construct
ugaguccuuuguucucugcuu

SEQ ID NO: 2359 - RNA, 22 nt, Artificial Sequence
  Synthetic Construct
agagaguuaagauaaucaguuu

SEQ ID NO: 2360 - RNA, 23 nt, Artificial Sequence
  Synthetic Construct
aaggcauaugguacucagagauu

SEQ ID NO: 2361 - RNA, 23 nt, Artificial Sequence
  Synthetic Construct
ucaaggccagaggucccacagca

SEQ ID NO: 2362 - RNA, 22 nt, Artificial Sequence
  Synthetic Construct
cuaauccaacauuacuaguuuu

SEQ ID NO: 2363 - RNA, 22 nt, Artificial Sequence
  Synthetic Construct
uagcagucacauauacauauuu

SEQ ID NO: 2364 - RNA, 21 nt, Artificial Sequence
  Synthetic Construct
acuccaguuuuaguucucuug

SEQ ID NO: 2365 - RNA, 21 nt, Artificial Sequence
  Synthetic Construct
ucugccugcuuuuuggccauu

SEQ ID NO: 2366 - RNA, 21 nt, Artificial Sequence
  Synthetic Construct
gccuaucacauaucugccugu

SEQ ID NO: 2367 - RNA, 22 nt, Artificial Sequence
  Synthetic Construct
ggaggaaccuuggagcuucggc

SEQ ID NO: 2368 - RNA, 23 nt, Artificial Sequence
  Synthetic Construct
uggucuacucacaucagccucuu

SEQ ID NO: 2369 - RNA, 22 nt, Artificial Sequence
  Synthetic Construct
ugcucagguugcacagcuggga

SEQ ID NO: 2370 - RNA, 22 nt, Artificial Sequence
  Synthetic Construct
ggcuggugcucguaucuacauu

SEQ ID NO: 2371 - RNA, 22 nt, Artificial Sequence
  Synthetic Construct
caucugccauacaccccuuauu

SEQ ID NO: 2372 - RNA, 23 nt, Artificial Sequence
  Synthetic Construct
cccauugcuacagccgccuguuu

SEQ ID NO: 2373 - RNA, 22 nt, Artificial Sequence
  Synthetic Construct
ggguuaucuacaagggaauuuu

SEQ ID NO: 2374 - RNA, 22 nt, Artificial Sequence
  Synthetic Construct
cauccuguggucugcgcguauu

SEQ ID NO: 2375 - RNA, 22 nt, Artificial Sequence
  Synthetic Construct
cagcccggaucccagcccacuu

SEQ ID NO: 2376 - RNA, 22 nt, Artificial Sequence
  Synthetic Construct
ugauccucaguuguguguaauu

SEQ ID NO: 2377 - RNA, 21 nt, Artificial Sequence
  Synthetic Construct
uuucagauaacaguauuacau

SEQ ID NO: 2378 - RNA, 23 nt, Artificial Sequence
  Synthetic Construct
ccaagugaagccugggggcuauu

SEQ ID NO: 2379 - RNA, 21 nt, Artificial Sequence
  Synthetic Construct
ugugcagcaggccaaccgaga

SEQ ID NO: 2380 - RNA, 23 nt, Artificial Sequence
  Synthetic Construct
aucaacccucuccuaugcccuuu

SEQ ID NO: 2381 - RNA, 20 nt, Artificial Sequence
  Synthetic Construct
cccgccuccgccgccgccuu

SEQ ID NO: 2382 - RNA, 22 nt, Artificial Sequence
  Synthetic Construct
cccuggaacggggcuggcaguu

SEQ ID NO: 2383 - RNA, 23 nt, Artificial Sequence
  Synthetic Construct
aaggcuaaugcuguacuuuguuu

SEQ ID NO: 2384 - RNA, 23 nt, Artificial Sequence
  Synthetic Construct
auuaaccuuacaaugaccuuuuu

SEQ ID NO: 2385 - RNA, 22 nt, Artificial Sequence
  Synthetic Construct
gaaguagugcauuagccucauu

SEQ ID NO: 2386 - RNA, 24 nt, Artificial Sequence
  Synthetic Construct
auuaaucuuccugcucucuauauu

SEQ ID NO: 2387 - RNA, 23 nt, Artificial Sequence
  Synthetic Construct
agguuaauuacgaugaagcacuu

SEQ ID NO: 2388 - RNA, 24 nt, Artificial Sequence
  Synthetic Construct
acccuggaugcaugcuuuccacuu

SEQ ID NO: 2389 - RNA, 23 nt, Artificial Sequence
  Synthetic Construct
agguuacccgagcaacuuugcau

SEQ ID NO: 2390 - RNA, 21 nt, Artificial Sequence
  Synthetic Construct
aauauaacacagauggccugu

SEQ ID NO: 2391 - RNA, 21 nt, Artificial Sequence
  Synthetic Construct
uaguagaccguauagcguacg

SEQ ID NO: 2392 - RNA, 23 nt, Artificial Sequence
  Synthetic Construct
acuucaccugguccacuagccgu

SEQ ID NO: 2393 - RNA, 23 nt, Artificial Sequence
  Synthetic Construct
gcccaauuaaugucuguugauuu

SEQ ID NO: 2394 - RNA, 22 nt, Artificial Sequence
  Synthetic Construct
cuucugacccuaaguccaguuu

SEQ ID NO: 2395 - RNA, 23 nt, Artificial Sequence
  Synthetic Construct
agcucggucugaggccccucagu

SEQ ID NO: 2396 - RNA, 21 nt, Artificial Sequence
  Synthetic Construct
caaaacgugaggcgcugcuau

SEQ ID NO: 2397 - RNA, 23 nt, Artificial Sequence
  Synthetic Construct
aaugacacgaucacucccguuga

SEQ ID NO: 2398 - RNA, 17 nt, Artificial Sequence
  Synthetic Construct
ggcccuuuucucagguu

SEQ ID NO: 2399 - RNA, 19 nt, Artificial Sequence
  Synthetic Construct
gugcugacucaguggccuu

SEQ ID NO: 2400 - RNA, 18 nt, Artificial Sequence
  Synthetic Construct
ccccuggacaugcccuuu

SEQ ID NO: 2401 - RNA, 23 nt, Artificial Sequence
  Synthetic Construct
gaugguggaguagcuccaggcuu

SEQ ID NO: 2402 - RNA, 17 nt, Artificial Sequence
  Synthetic Construct
caucucugaacacuguu

SEQ ID NO: 2403 - RNA, 18 nt, Artificial Sequence
  Synthetic Construct
cuucaucaggucagauuu

SEQ ID NO: 2404 - RNA, 18 nt, Artificial Sequence
  Synthetic Construct
caguccccaccucugguu

SEQ ID NO: 2405 - RNA, 17 nt, Artificial Sequence
  Synthetic Construct
aaggcgguggcgggguu

SEQ ID NO: 2406 - RNA, 22 nt, Artificial Sequence
  Synthetic Construct
cugaccccuagacccaacuguu

SEQ ID NO: 2407 - RNA, 19 nt, Artificial Sequence
  Synthetic Construct
ggacuccaugccccaaguu

SEQ ID NO: 2408 - RNA, 16 nt, Artificial Sequence
  Synthetic Construct
ggucccuguuuccuuu

SEQ ID NO: 2409 - RNA, 17 nt, Artificial Sequence
  Synthetic Construct
gguagucugaaugucuu

SEQ ID NO: 2410 - RNA, 18 nt, Artificial Sequence
  Synthetic Construct
ccaaggcacuuagaauuu

SEQ ID NO: 2411 - RNA, 17 nt, Artificial Sequence
  Synthetic Construct
ugaccaugacugaguuu

SEQ ID NO: 2412 - RNA, 19 nt, Artificial Sequence
  Synthetic Construct
cagagcugagcccacaguu

SEQ ID NO: 2413 - RNA, 16 nt, Artificial Sequence
  Synthetic Construct
ccaaggccuccuaguu

SEQ ID NO: 2414 - RNA, 16 nt, Artificial Sequence
  Synthetic Construct
gccaccgagcuggauu

SEQ ID NO: 2415 - RNA, 21 nt, Artificial Sequence
  Synthetic Construct
cauccugagaggaggagccuu

SEQ ID NO: 2416 - RNA, 21 nt, Artificial Sequence
  Synthetic Construct
cagggcugucugugccugcuu

SEQ ID NO: 2417 - RNA, 20 nt, Artificial Sequence
  Synthetic Construct
ccuccccugacucccugauu

SEQ ID NO: 2418 - RNA, 19 nt, Artificial Sequence
  Synthetic Construct
ccaccuuuucuucccccuu

SEQ ID NO: 2419 - RNA, 18 nt, Artificial Sequence
  Synthetic Construct
aaucacuaguugaauguu

SEQ ID NO: 2420 - RNA, 18 nt, Artificial Sequence
  Synthetic Construct
guccaucagagaacacuu

SEQ ID NO: 2421 - RNA, 18 nt, Artificial Sequence
  Synthetic Construct
gggggagggacugcuguu

SEQ ID NO: 2422 - RNA, 17 nt, Artificial Sequence
  Synthetic Construct
agaagugguaauugguu

SEQ ID NO: 2423 - RNA, 17 nt, Artificial Sequence
  Synthetic Construct
acaugagucacugaguu

SEQ ID NO: 2424 - RNA, 21 nt, Artificial Sequence
  Synthetic Construct
guacugugcucagaacugcuu

SEQ ID NO: 2425 - RNA, 18 nt, Artificial Sequence
  Synthetic Construct
agggcaaacccccuaguu

SEQ ID NO: 2426 - RNA, 16 nt, Artificial Sequence
  Synthetic Construct
agccgggaggagaguu

SEQ ID NO: 2427 - RNA, 21 nt, Artificial Sequence
  Synthetic Construct
ucugcucagaacuacacucuu

SEQ ID NO: 2428 - RNA, 18 nt, Artificial Sequence
  Synthetic Construct
ccccuccccgggacccuu

SEQ ID NO: 2429 - RNA, 18 nt, Artificial Sequence
  Synthetic Construct
cuggaugcaaauuuuauu

SEQ ID NO: 2430 - RNA, 17 nt, Artificial Sequence
  Synthetic Construct
acucgcugagccccauu

SEQ ID NO: 2431 - RNA, 18 nt, Artificial Sequence
  Synthetic Construct
ggggugaugugagcccuu

SEQ ID NO: 2432 - RNA, 18 nt, Artificial Sequence
  Synthetic Construct
gagucggacucgccgcuu

SEQ ID NO: 2433 - RNA, 17 nt, Artificial Sequence
  Synthetic Construct
uaccaggagugggguuu

SEQ ID NO: 2434 - RNA, 19 nt, Artificial Sequence
  Synthetic Construct
agugcccucaagggagauu

SEQ ID NO: 2435 - RNA, 17 nt, Artificial Sequence
  Synthetic Construct
aaacucagcagacaauu

SEQ ID NO: 2436 - RNA, 19 nt, Artificial Sequence
  Synthetic Construct
auagcccugcacaaugcuu

SEQ ID NO: 2437 - RNA, 22 nt, Artificial Sequence
  Synthetic Construct
gguuuuaccagacaguauuauu

SEQ ID NO: 2438 - RNA, 19 nt, Artificial Sequence
  Synthetic Construct
gggaagaaaggagggcauu

SEQ ID NO: 2439 - RNA, 16 nt, Artificial Sequence
  Synthetic Construct
cuguuccugcugaauu

SEQ ID NO: 2440 - RNA, 18 nt, Artificial Sequence
  Synthetic Construct
aaggccggcccagggguu

SEQ ID NO: 2441 - RNA, 17 nt, Artificial Sequence
  Synthetic Construct
guuccugucaggcuguu

SEQ ID NO: 2442 - RNA, 17 nt, Artificial Sequence
  Synthetic Construct
cugcuguagacucccuu

SEQ ID NO: 2443 - RNA, 18 nt, Artificial Sequence
  Synthetic Construct
ggaaaacauugcacuguu

SEQ ID NO: 2444 - RNA, 17 nt, Artificial Sequence
  Synthetic Construct
agccugagcccacauuu

SEQ ID NO: 2445 - RNA, 16 nt, Artificial Sequence
  Synthetic Construct
cagacaggaaggcauu

SEQ ID NO: 2446 - RNA, 22 nt, Artificial Sequence
  Synthetic Construct
gccuccuccuccugucccaguu

SEQ ID NO: 2447 - RNA, 18 nt, Artificial Sequence
  Synthetic Construct
cucucaugucaccagcuu

SEQ ID NO: 2448 - RNA, 18 nt, Artificial Sequence
  Synthetic Construct
aguaguccagcucccauu

SEQ ID NO: 2449 - RNA, 20 nt, Artificial Sequence
  Synthetic Construct
acaagugaaguagugggauu

SEQ ID NO: 2450 - RNA, 18 nt, Artificial Sequence
  Synthetic Construct
cgcugagccacacugguu

SEQ ID NO: 2451 - RNA, 17 nt, Artificial Sequence
  Synthetic Construct
guccucagcucagaauu

SEQ ID NO: 2452 - RNA, 17 nt, Artificial Sequence
  Synthetic Construct
cccuggacaugccgguu

SEQ ID NO: 2453 - RNA, 18 nt, Artificial Sequence
  Synthetic Construct
acuggaggugucuagguu

SEQ ID NO: 2454 - RNA, 17 nt, Artificial Sequence
  Synthetic Construct
cugccuuucucuccauu

SEQ ID NO: 2455 - RNA, 19 nt, Artificial Sequence
  Synthetic Construct
aaacaggaaaaaacauuuu

SEQ ID NO: 2456 - RNA, 18 nt, Artificial Sequence
  Synthetic Construct
gaagaaacuccagggauu

SEQ ID NO: 2457 - RNA, 18 nt, Artificial Sequence
  Synthetic Construct
gaauccuagacuccaguu

SEQ ID NO: 2458 - RNA, 22 nt, Artificial Sequence
  Synthetic Construct
caggucgucuugcagggcuucu

SEQ ID NO: 2459 - RNA, 16 nt, Artificial Sequence
  Synthetic Construct
gacaugaaugcugcuu

SEQ ID NO: 2460 - RNA, 18 nt, Artificial Sequence
  Synthetic Construct
cacucagcucucuuucuu

SEQ ID NO: 2461 - RNA, 19 nt, Artificial Sequence
  Synthetic Construct
gggacaggaacaaggccuu

SEQ ID NO: 2462 - RNA, 20 nt, Artificial Sequence
  Synthetic Construct
guuuggggccagggggcuuu

SEQ ID NO: 2463 - RNA, 18 nt, Artificial Sequence
  Synthetic Construct
gucccauuucccagaguu

SEQ ID NO: 2464 - RNA, 18 nt, Artificial Sequence
  Synthetic Construct
ccagcucagaaagcgguu

SEQ ID NO: 2465 - RNA, 17 nt, Artificial Sequence
  Synthetic Construct
ccagcuagccucaccuu

SEQ ID NO: 2466 - RNA, 17 nt, Artificial Sequence
  Synthetic Construct
acucccuggcaauguuu

SEQ ID NO: 2467 - RNA, 17 nt, Artificial Sequence
  Synthetic Construct
cauguacccacaguguu

SEQ ID NO: 2468 - RNA, 17 nt, Artificial Sequence
  Synthetic Construct
ggcuuugcucagggauu

SEQ ID NO: 2469 - RNA, 21 nt, Artificial Sequence
  Synthetic Construct
cuggauggcuccuccaugucu

SEQ ID NO: 2470 - RNA, 18 nt, Artificial Sequence
  Synthetic Construct
gaagcuacagaaucccuu

SEQ ID NO: 2471 - RNA, 21 nt, Artificial Sequence
  Synthetic Construct
cagggcgguccaccgcuaauu

SEQ ID NO: 2472 - RNA, 21 nt, Artificial Sequence
  Synthetic Construct
ccacgcgcugagcccacaguu

SEQ ID NO: 2473 - RNA, 18 nt, Artificial Sequence
  Synthetic Construct
ugaggcuguggggcuguu

SEQ ID NO: 2474 - RNA, 20 nt, Artificial Sequence
  Synthetic Construct
aagguuagggucucaggguu

SEQ ID NO: 2475 - RNA, 18 nt, Artificial Sequence
  Synthetic Construct
acugagacaagugcaauu

SEQ ID NO: 2476 - RNA, 20 nt, Artificial Sequence
  Synthetic Construct
cugggagacagaggaacauu

SEQ ID NO: 2477 - RNA, 19 nt, Artificial Sequence
  Synthetic Construct
agucccccaugcaagccuu

SEQ ID NO: 2478 - RNA, 17 nt, Artificial Sequence
  Synthetic Construct
uccugggaaaacugguu

SEQ ID NO: 2479 - RNA, 19 nt, Artificial Sequence
  Synthetic Construct
ggaacuagggucucagguu

SEQ ID NO: 2480 - RNA, 22 nt, Artificial Sequence
  Synthetic Construct
aucaugaugggcuccucggugu

SEQ ID NO: 2481 - RNA, 19 nt, Artificial Sequence
  Synthetic Construct
aaggcucugaucugagguu

SEQ ID NO: 2482 - RNA, 18 nt, Artificial Sequence
  Synthetic Construct
cuccgggaagcccaccuu

SEQ ID NO: 2483 - RNA, 18 nt, Artificial Sequence
  Synthetic Construct
gcugaguccugcaguguu

SEQ ID NO: 2484 - RNA, 17 nt, Artificial Sequence
  Synthetic Construct
cagucuccucccucauu

SEQ ID NO: 2485 - RNA, 18 nt, Artificial Sequence
  Synthetic Construct
aucuuccuucagccucuu

SEQ ID NO: 2486 - RNA, 22 nt, Artificial Sequence
  Synthetic Construct
cagcuacagacaucagugacuu

SEQ ID NO: 2487 - RNA, 22 nt, Artificial Sequence
  Synthetic Construct
gcuccuuuccacagacagguuu

SEQ ID NO: 2488 - RNA, 21 nt, Artificial Sequence
  Synthetic Construct
gguacuuccugaugcuuuuuu

SEQ ID NO: 2489 - RNA, 21 nt, Artificial Sequence
  Synthetic Construct
auaggcaccaaaaagcaacaa

SEQ ID NO: 2490 - RNA, 22 nt, Artificial Sequence
  Synthetic Construct
guccauuuugaguuaacucuuu

SEQ ID NO: 2491 - RNA, 22 nt, Artificial Sequence
  Synthetic Construct
gguccugcugaaucccaacauu

SEQ ID NO: 2492 - RNA, 17 nt, Artificial Sequence
  Synthetic Construct
aguacguccaucuucuu

SEQ ID NO: 2493 - RNA, 21 nt, Artificial Sequence
  Synthetic Construct
ucuucagacucuauucagauu

SEQ ID NO: 2494 - RNA, 22 nt, Artificial Sequence
  Synthetic Construct
uccauguucccgucuccuuguu

SEQ ID NO: 2495 - RNA, 20 nt, Artificial Sequence
  Synthetic Construct
ccucucagcccagcuuuuuu

SEQ ID NO: 2496 - RNA, 18 nt, Artificial Sequence
  Synthetic Construct
ccgcucacuccagccuuu

SEQ ID NO: 2497 - RNA, 22 nt, Artificial Sequence
  Synthetic Construct
cuucuaguuuucagagucgcuu

SEQ ID NO: 2498 - RNA, 20 nt, Artificial Sequence
  Synthetic Construct
gcaucuugcagagucuuuuu

SEQ ID NO: 2499 - RNA, 21 nt, Artificial Sequence
  Synthetic Construct
cgucccaccccccacuccugu

SEQ ID NO: 2500 - RNA, 21 nt, Artificial Sequence
  Synthetic Construct
augucccacccccacuccugu

SEQ ID NO: 2501 - RNA, 18 nt, Artificial Sequence
  Synthetic Construct
cuacuuuacuucuccuuu

SEQ ID NO: 2502 - RNA, 22 nt, Artificial Sequence
  Synthetic Construct
ucugugugagcucuggccauuu

SEQ ID NO: 2503 - RNA, 21 nt, Artificial Sequence
  Synthetic Construct
ccacuucugccuguccugcuu

SEQ ID NO: 2504 - RNA, 22 nt, Artificial Sequence
  Synthetic Construct
cagggcaggaagaaguggacaa

SEQ ID NO: 2505 - RNA, 21 nt, Artificial Sequence
  Synthetic Construct
ccuuuguacccugagcccauu

SEQ ID NO: 2506 - RNA, 21 nt, Artificial Sequence
  Synthetic Construct
ugucuuuucuaagccuguguu

SEQ ID NO: 2507 - RNA, 22 nt, Artificial Sequence
  Synthetic Construct
gccuccaagguaucagucacuu

SEQ ID NO: 2508 - RNA, 22 nt, Artificial Sequence
  Synthetic Construct
agccagcaagccccacgacauu

SEQ ID NO: 2509 - RNA, 17 nt, Artificial Sequence
  Synthetic Construct
caaucuccucccuguuu

SEQ ID NO: 2510 - RNA, 17 nt, Artificial Sequence
  Synthetic Construct
ucccucuuguccggcuu

SEQ ID NO: 2511 - RNA, 17 nt, Artificial Sequence
  Synthetic Construct
aacccacgccuccaauu

SEQ ID NO: 2512 - RNA, 18 nt, Artificial Sequence
  Synthetic Construct
ccucuuccaacucgaguu

SEQ ID NO: 2513 - RNA, 21 nt, Artificial Sequence
  Synthetic Construct
cacggcaaaagaaacaaucca

SEQ ID NO: 2514 - RNA, 22 nt, Artificial Sequence
  Synthetic Construct
cagggcuggcagugacaugggu

SEQ ID NO: 2515 - RNA, 17 nt, Artificial Sequence
  Synthetic Construct
acaacagcccccaccuu

SEQ ID NO: 2516 - RNA, 20 nt, Artificial Sequence
  Synthetic Construct
ccccuagaccaaggagccuu

SEQ ID NO: 2517 - RNA, 22 nt, Artificial Sequence
  Synthetic Construct
ccucgcgcagccccgggacguu

SEQ ID NO: 2518 - RNA, 22 nt, Artificial Sequence
  Synthetic Construct
accacuucuccaaauccccauu

SEQ ID NO: 2519 - RNA, 17 nt, Artificial Sequence
  Synthetic Construct
uccucagcucuaccauu

SEQ ID NO: 2520 - RNA, 23 nt, Artificial Sequence
  Synthetic Construct
cacuuaaggccaagaauucaauu

SEQ ID NO: 2521 - RNA, 20 nt, Artificial Sequence
  Synthetic Construct
ccgcuacagaccaagcucuu

SEQ ID NO: 2522 - RNA, 20 nt, Artificial Sequence
  Synthetic Construct
gugccgugacucggauccuu

SEQ ID NO: 2523 - RNA, 17 nt, Artificial Sequence
  Synthetic Construct
aaacacacacacccuuu

SEQ ID NO: 2524 - RNA, 17 nt, Artificial Sequence
  Synthetic Construct
aaggaagccaccagguu

SEQ ID NO: 2525 - RNA, 22 nt, Artificial Sequence
  Synthetic Construct
cgccagucaauaccuugugauu

SEQ ID NO: 2526 - RNA, 19 nt, Artificial Sequence
  Synthetic Construct
cuuccacaccuaccucuuu

SEQ ID NO: 2527 - RNA, 22 nt, Artificial Sequence
  Synthetic Construct
ccaccuccuccgccuccugguu

SEQ ID NO: 2528 - RNA, 22 nt, Artificial Sequence
  Synthetic Construct
gguaaauucacaaccacuauuu

SEQ ID NO: 2529 - RNA, 23 nt, Artificial Sequence
  Synthetic Construct
cuagcccuacuagucucaaucuu

SEQ ID NO: 2530 - RNA, 23 nt, Artificial Sequence
  Synthetic Construct
cccaagccacccuccgugucauu

SEQ ID NO: 2531 - RNA, 17 nt, Artificial Sequence
  Synthetic Construct
ccccaccccagucucuu

SEQ ID NO: 2532 - RNA, 21 nt, Artificial Sequence
  Synthetic Construct
uugcaucuauccaaaccuuuu

SEQ ID NO: 2533 - RNA, 22 nt, Artificial Sequence
  Synthetic Construct
cccuggucagacuacuugaguu

SEQ ID NO: 2534 - RNA, 18 nt, Artificial Sequence
  Synthetic Construct
ccgccggcccgcacccuu

SEQ ID NO: 2535 - RNA, 22 nt, Artificial Sequence
  Synthetic Construct
gcccauaacuaccgccgccauu

SEQ ID NO: 2536 - RNA, 18 nt, Artificial Sequence
  Synthetic Construct
cucauccuucugcucuuu

SEQ ID NO: 2537 - RNA, 22 nt, Artificial Sequence
  Synthetic Construct
cgagcgacccuagagggagcuu

SEQ ID NO: 2538 - RNA, 21 nt, Artificial Sequence
  Synthetic Construct
ucggcuuccacguuugccauu

SEQ ID NO: 2539 - RNA, 22 nt, Artificial Sequence
  Synthetic Construct
aaaccucuacuaaguucccauu

SEQ ID NO: 2540 - RNA, 18 nt, Artificial Sequence
  Synthetic Construct
aacaacaccccccaccuu

SEQ ID NO: 2541 - RNA, 22 nt, Artificial Sequence
  Synthetic Construct
cuuguaacggagagcacuaguu

SEQ ID NO: 2542 - RNA, 21 nt, Artificial Sequence
  Synthetic Construct
uuagucucaugaucagacaca

SEQ ID NO: 2543 - RNA, 22 nt, Artificial Sequence
  Synthetic Construct
aaugaaugcuuggucccuuguu

SEQ ID NO: 2544 - RNA, 22 nt, Artificial Sequence
  Synthetic Construct
cugucccuaaauccuuccuguu

SEQ ID NO: 2545 - RNA, 22 nt, Artificial Sequence
  Synthetic Construct
aucacaaauguccuuaauaguu

SEQ ID NO: 2546 - RNA, 22 nt, Artificial Sequence
  Synthetic Construct
caaucacaaauguccuuaauuu

SEQ ID NO: 2547 - RNA, 17 nt, Artificial Sequence
  Synthetic Construct
ccucagcucagccucuu

SEQ ID NO: 2548 - RNA, 22 nt, Artificial Sequence
  Synthetic Construct
gcuccgagcacggccgcgcguu

SEQ ID NO: 2549 - RNA, 22 nt, Artificial Sequence
  Synthetic Construct
gggacauccuacauaugcaauu

SEQ ID NO: 2550 - RNA, 21 nt, Artificial Sequence
  Synthetic Construct
aaguaacuuccacuuggcuuu

SEQ ID NO: 2551 - RNA, 17 nt, Artificial Sequence
  Synthetic Construct
ccaccagcccacuccuu

SEQ ID NO: 2552 - RNA, 22 nt, Artificial Sequence
  Synthetic Construct
aacccagugggcuauggaaaug

SEQ ID NO: 2553 - RNA, 17 nt, Artificial Sequence
  Synthetic Construct
acaacagaccaccccuu

SEQ ID NO: 2554 - RNA, 20 nt, Artificial Sequence
  Synthetic Construct
gggcuucucccgccuuuuuu

SEQ ID NO: 2555 - RNA, 16 nt, Artificial Sequence
  Synthetic Construct
accgccugcccaguga

SEQ ID NO: 2556 - RNA, 17 nt, Artificial Sequence
  Synthetic Construct
ccagccucgcccagcuu

SEQ ID NO: 2557 - RNA, 19 nt, Artificial Sequence
  Synthetic Construct
gcccuucagccagcucuuu

SEQ ID NO: 2558 - RNA, 18 nt, Artificial Sequence
  Synthetic Construct
ccggagcccgcccccuuu

SEQ ID NO: 2559 - RNA, 21 nt, Artificial Sequence
  Synthetic Construct
uccugcaucacuagccccauu

SEQ ID NO: 2560 - RNA, 22 nt, Artificial Sequence
  Synthetic Construct
ugcccaaaucucuuaccagauu

SEQ ID NO: 2561 - RNA, 22 nt, Artificial Sequence
  Synthetic Construct
uggucacaccaguccacauuuu

SEQ ID NO: 2562 - RNA, 17 nt, Artificial Sequence
  Synthetic Construct
cgcgcgcccagccccuu

SEQ ID NO: 2563 - RNA, 21 nt, Artificial Sequence
  Synthetic Construct
agagauggaaaggccuucuuu

SEQ ID NO: 2564 - RNA, 22 nt, Artificial Sequence
  Synthetic Construct
ucuggucagccacagucugguu

SEQ ID NO: 2565 - RNA, 21 nt, Artificial Sequence
  Synthetic Construct
caaaaagccuguuuacauuuu

SEQ ID NO: 2566 - RNA, 22 nt, Artificial Sequence
  Synthetic Construct
cucucagcuucaguuuccucuu

SEQ ID NO: 2567 - RNA, 17 nt, Artificial Sequence
  Synthetic Construct
ccagccgucccggaguu

SEQ ID NO: 2568 - RNA, 22 nt, Artificial Sequence
  Synthetic Construct
gcacuugcccugccagcccauu

SEQ ID NO: 2569 - RNA, 17 nt, Artificial Sequence
  Synthetic Construct
ccuccucucagucuuuu

SEQ ID NO: 2570 - RNA, 22 nt, Artificial Sequence
  Synthetic Construct
cagcuaacaauacacugccauu

SEQ ID NO: 2571 - RNA, 22 nt, Artificial Sequence
  Synthetic Construct
aggcaguguauuguuagcuggc

SEQ ID NO: 2572 - RNA, 23 nt, Artificial Sequence
  Synthetic Construct
uugcuaguugcacuccucucugu

SEQ ID NO: 2573 - RNA, 17 nt, Artificial Sequence
  Synthetic Construct
gaaacuacuaccucauu

SEQ ID NO: 2574 - RNA, 21 nt, Artificial Sequence
  Synthetic Construct
auucauccgaggucacauauu

SEQ ID NO: 2575 - RNA, 22 nt, Artificial Sequence
  Synthetic Construct
ucagcaccaucaucaucagcuu

SEQ ID NO: 2576 - RNA, 22 nt, Artificial Sequence
  Synthetic Construct
aauucuauuuccugcuuaaauu

SEQ ID NO: 2577 - RNA, 22 nt, Artificial Sequence
  Synthetic Construct
uguucaucucuauugucacauu

SEQ ID NO: 2578 - RNA, 18 nt, Artificial Sequence
  Synthetic Construct
cgucccagcccagccuuu

SEQ ID NO: 2579 - RNA, 20 nt, Artificial Sequence
  Synthetic Construct
gccucagaccacccauuuuu

SEQ ID NO: 2580 - RNA, 20 nt, Artificial Sequence
  Synthetic Construct
cagcccagcccaacccaguu

SEQ ID NO: 2581 - RNA, 17 nt, Artificial Sequence
  Synthetic Construct
cgcgcccagccccgcuu

SEQ ID NO: 2582 - RNA, 22 nt, Artificial Sequence
  Synthetic Construct
aaccuucuauauccuuuaguuu

SEQ ID NO: 2583 - RNA, 22 nt, Artificial Sequence
  Synthetic Construct
auugggaacauuuugcauguau

SEQ ID NO: 2584 - RNA, 22 nt, Artificial Sequence
  Synthetic Construct
auuggggacauuuugcauucau

SEQ ID NO: 2585 - RNA, 22 nt, Artificial Sequence
  Synthetic Construct
uugggaucauuuugcauccaua

SEQ ID NO: 2586 - RNA, 22 nt, Artificial Sequence
  Synthetic Construct
ccauacauccuacucccucauu

SEQ ID NO: 2587 - RNA, 22 nt, Artificial Sequence
  Synthetic Construct
ggcaaaugcaacaguucuucuu

SEQ ID NO: 2588 - RNA, 22 nt, Artificial Sequence
  Synthetic Construct
ggcgauacagugaggcccuguu

SEQ ID NO: 2589 - RNA, 22 nt, Artificial Sequence
  Synthetic Construct
gggccuccagccgucagucuuu

SEQ ID NO: 2590 - RNA, 18 nt, Artificial Sequence
  Synthetic Construct
ccccaauccugccuguuu

SEQ ID NO: 2591 - RNA, 22 nt, Artificial Sequence
  Synthetic Construct
gcugccgggaguccaguccuuu

SEQ ID NO: 2592 - RNA, 17 nt, Artificial Sequence
  Synthetic Construct
cccgacccuucucccuu

SEQ ID NO: 2593 - RNA, 25 nt, Artificial Sequence
  Synthetic Construct
cagcugugaguuucaucauauuuuu

SEQ ID NO: 2594 - RNA, 26 nt, Artificial Sequence
  Synthetic Construct
ucagcacaguuaucaucccugagcuu

SEQ ID NO: 2595 - RNA, 18 nt, Artificial Sequence
  Synthetic Construct
gcccugcgcacugcuguu

SEQ ID NO: 2596 - RNA, 22 nt, Artificial Sequence
  Synthetic Construct
cucaguaaugguaacgguuuuu

SEQ ID NO: 2597 - RNA, 22 nt, Artificial Sequence
  Synthetic Construct
ugguaaugguucucuugcuauu

SEQ ID NO: 2598 - RNA, 22 nt, Artificial Sequence
  Synthetic Construct
cucaucugcaaagaaguaagug

SEQ ID NO: 2599 - RNA, 22 nt, Artificial Sequence
  Synthetic Construct
uuggacagaaaacacgcaggaa

SEQ ID NO: 2600 - RNA, 22 nt, Artificial Sequence
  Synthetic Construct
uuuggacagaaaacacgcaggu

SEQ ID NO: 2601 - RNA, 22 nt, Artificial Sequence
  Synthetic Construct
gagcacaggacuuccuuagcuu

SEQ ID NO: 2602 - RNA, 21 nt, Artificial Sequence
  Synthetic Construct
cggccuacaggcagagucauu

SEQ ID NO: 2603 - RNA, 21 nt, Artificial Sequence
  Synthetic Construct
agccgaggcccucucggucuu

SEQ ID NO: 2604 - RNA, 22 nt, Artificial Sequence
  Synthetic Construct
ugagacaggcuuaugcugcuau

SEQ ID NO: 2605 - RNA, 20 nt, Artificial Sequence
  Synthetic Construct
gagacagguucaugcugcua

SEQ ID NO: 2606 - RNA, 21 nt, Artificial Sequence
  Synthetic Construct
ccagcaugcacauccccccuu

SEQ ID NO: 2607 - RNA, 22 nt, Artificial Sequence
  Synthetic Construct
cggccagcccugcugucagcuu

SEQ ID NO: 2608 - RNA, 22 nt, Artificial Sequence
  Synthetic Construct
agucaucucuuugcagaccauu

SEQ ID NO: 2609 - RNA, 22 nt, Artificial Sequence
  Synthetic Construct
ccagaucauacauauaaugauu

SEQ ID NO: 2610 - RNA, 21 nt, Artificial Sequence
  Synthetic Construct
auuggacugcugauggcccgu

SEQ ID NO: 2611 - RNA, 18 nt, Artificial Sequence
  Synthetic Construct
cucccguccugcuggguu

SEQ ID NO: 2612 - RNA, 17 nt, Artificial Sequence
  Synthetic Construct
agaagccuucuccauuu

SEQ ID NO: 2613 - RNA, 17 nt, Artificial Sequence
  Synthetic Construct
ccgggcuccccgggguu

SEQ ID NO: 2614 - RNA, 22 nt, Artificial Sequence
  Synthetic Construct
cguccggcaaccuccuuccauu

SEQ ID NO: 2615 - RNA, 17 nt, Artificial Sequence
  Synthetic Construct
accccuccuccauccuu

SEQ ID NO: 2616 - RNA, 17 nt, Artificial Sequence
  Synthetic Construct
cccagccagguccacuu

SEQ ID NO: 2617 - RNA, 21 nt, Artificial Sequence
  Synthetic Construct
ugugguagauauaugcacgau

SEQ ID NO: 2618 - RNA, 22 nt, Artificial Sequence
  Synthetic Construct
gcuaagcucagcucggcucauu

SEQ ID NO: 2619 - RNA, 22 nt, Artificial Sequence
  Synthetic Construct
agcccagcucauccaagcucuu

SEQ ID NO: 2620 - RNA, 22 nt, Artificial Sequence
  Synthetic Construct
ccagcucagcccaguucagcuu

SEQ ID NO: 2621 - RNA, 23 nt, Artificial Sequence
  Synthetic Construct
uagugcaauauugcuuauagggu

SEQ ID NO: 2622 - RNA, 21 nt, Artificial Sequence
  Synthetic Construct
aaccuacaggcaggacuaauu

SEQ ID NO: 2623 - RNA, 22 nt, Artificial Sequence
  Synthetic Construct
uaugugccuuuggacuacaucg

SEQ ID NO: 2624 - RNA, 23 nt, Artificial Sequence
  Synthetic Construct
gagggcagcguggguguggcgga

SEQ ID NO: 2625 - RNA, 22 nt, Artificial Sequence
  Synthetic Construct
aggagcuagccaggcauaugca

SEQ ID NO: 2626 - RNA, 19 nt, Artificial Sequence
  Synthetic Construct
ccgggccggucgcgccguu

SEQ ID NO: 2627 - RNA, 21 nt, Artificial Sequence
  Synthetic Construct
gcggguucugacuucaagauu

SEQ ID NO: 2628 - RNA, 22 nt, Artificial Sequence
  Synthetic Construct
aaaggcuuugaacacgaguuuu

SEQ ID NO: 2629 - RNA, 22 nt, Artificial Sequence
  Synthetic Construct
acuugaaucugcaguuaguauu

SEQ ID NO: 2630 - RNA, 21 nt, Artificial Sequence
  Synthetic Construct
acucggcugcgguggacaagu

SEQ ID NO: 2631 - RNA, 22 nt, Artificial Sequence
  Synthetic Construct
uugcuaaguaggcugagauuga

SEQ ID NO: 2632 - RNA, 22 nt, Artificial Sequence
  Synthetic Construct
cacccccuguuuccuggcccac

SEQ ID NO: 2633 - RNA, 24 nt, Artificial Sequence
  Synthetic Construct
aggcaaaaguauggcaugggcauu

SEQ ID NO: 2634 - RNA, 22 nt, Artificial Sequence
  Synthetic Construct
ccaccaggggacgaugccauuu

SEQ ID NO: 2635 - RNA, 22 nt, Artificial Sequence
  Synthetic Construct
agcauuuauggucaugugucuu

SEQ ID NO: 2636 - RNA, 23 nt, Artificial Sequence
  Synthetic Construct
ucugucucuuuucucucuccauu

SEQ ID NO: 2637 - RNA, 22 nt, Artificial Sequence
  Synthetic Construct
agacaguaguucuugccugguu

SEQ ID NO: 2638 - RNA, 22 nt, Artificial Sequence
  Synthetic Construct
acugggaagaggagcugaggga

SEQ ID NO: 2639 - RNA, 23 nt, Artificial Sequence
  Synthetic Construct
ccucagcacagcaccaucuucuu

SEQ ID NO: 2640 - RNA, 20 nt, Artificial Sequence
  Synthetic Construct
cccauuugcagucccacauu

SEQ ID NO: 2641 - RNA, 21 nt, Artificial Sequence
  Synthetic Construct
ucugaggccugccucucccca

SEQ ID NO: 2642 - RNA, 19 nt, Artificial Sequence
  Synthetic Construct
ucaggccucuuucuaccuu

SEQ ID NO: 2643 - RNA, 20 nt, Artificial Sequence
  Synthetic Construct
ccgaccucacccaccccguu

SEQ ID NO: 2644 - RNA, 22 nt, Artificial Sequence
  Synthetic Construct
guucuguuaacccauccccuca

SEQ ID NO: 2645 - RNA, 23 nt, Artificial Sequence
  Synthetic Construct
uggaguuaaggguugcuuggaga

SEQ ID NO: 2646 - RNA, 22 nt, Artificial Sequence
  Synthetic Construct
agaugccuccagaucccacauu

SEQ ID NO: 2647 - RNA, 22 nt, Artificial Sequence
  Synthetic Construct
caccggggauggcagagggucg

SEQ ID NO: 2648 - RNA, 23 nt, Artificial Sequence
  Synthetic Construct
aggccuccugcccucagcccauu

SEQ ID NO: 2649 - RNA, 23 nt, Artificial Sequence
  Synthetic Construct
gccucagaccacuuccacauuuu

SEQ ID NO: 2650 - RNA, 23 nt, Artificial Sequence
  Synthetic Construct
uccuccaggauccacacucacuu

SEQ ID NO: 2651 - RNA, 22 nt, Artificial Sequence
  Synthetic Construct
cugccaugucuaagaagaaaac

SEQ ID NO: 2652 - RNA, 19 nt, Artificial Sequence
  Synthetic Construct
uugccaugucuaagaagaa

SEQ ID NO: 2653 - RNA, 23 nt, Artificial Sequence
  Synthetic Construct
guguguugcguguauguguauuu

SEQ ID NO: 2654 - RNA, 23 nt, Artificial Sequence
  Synthetic Construct
ccauuuuccaccagagcugcauu

SEQ ID NO: 2655 - RNA, 22 nt, Artificial Sequence
  Synthetic Construct
caggauccacagagcuagucca

SEQ ID NO: 2656 - RNA, 22 nt, Artificial Sequence
  Synthetic Construct
aaagauagacaauuggcuaaau

SEQ ID NO: 2657 - RNA, 22 nt, Artificial Sequence
  Synthetic Construct
uuagccaauuguccaucuuuuu

SEQ ID NO: 2658 - RNA, 24 nt, Artificial Sequence
  Synthetic Construct
ugcacguccauggagcucagcuuu

SEQ ID NO: 2659 - RNA, 22 nt, Artificial Sequence
  Synthetic Construct
uggggugcccacuccgcaaguu

SEQ ID NO: 2660 - RNA, 23 nt, Artificial Sequence
  Synthetic Construct
cugggggacgcgugagcgcgagc

SEQ ID NO: 2661 - RNA, 21 nt, Artificial Sequence
  Synthetic Construct
cauacaaucugacauguauuu

SEQ ID NO: 2662 - RNA, 23 nt, Artificial Sequence
  Synthetic Construct
gaauuacaaucugacaugcaauu

SEQ ID NO: 2663 - RNA, 21 nt, Artificial Sequence
  Synthetic Construct
ucccuccuucuguccccacag

SEQ ID NO: 2664 - RNA, 23 nt, Artificial Sequence
  Synthetic Construct
gaaaauccuuuuuguuuuuccag

SEQ ID NO: 2665 - RNA, 22 nt, Artificial Sequence
  Synthetic Construct
uccuccacuucccggacacauu

SEQ ID NO: 2666 - RNA, 22 nt, Artificial Sequence
  Synthetic Construct
ugaaguuacaucauggucgcuu

SEQ ID NO: 2667 - RNA, 21 nt, Artificial Sequence
  Synthetic Construct
uuagugcauagucuuuggucu

SEQ ID NO: 2668 - RNA, 21 nt, Artificial Sequence
  Synthetic Construct
ccucuguccagcuguguaauu

SEQ ID NO: 2669 - RNA, 22 nt, Artificial Sequence
  Synthetic Construct
caguccggcuccugccuggauu

SEQ ID NO: 2670 - RNA, 21 nt, Artificial Sequence
  Synthetic Construct
ccgcgcgucccgagcccaguu

SEQ ID NO: 2671 - RNA, 22 nt, Artificial Sequence
  Synthetic Construct
ugcuggucaaucacagccccuu

SEQ ID NO: 2672 - RNA, 22 nt, Artificial Sequence
  Synthetic Construct
cacuguuucaccacuggcucuu

SEQ ID NO: 2673 - RNA, 22 nt, Artificial Sequence
  Synthetic Construct
ucugugagaccaaagaacuacu

SEQ ID NO: 2674 - RNA, 22 nt, Artificial Sequence
  Synthetic Construct
auaagucugaacaauaccuuuu

SEQ ID NO: 2675 - RNA, 22 nt, Artificial Sequence
  Synthetic Construct
caaagaaucucuaucacagauu

SEQ ID NO: 2676 - RNA, 23 nt, Artificial Sequence
  Synthetic Construct
agaacucuugcagucuuagaugu

SEQ ID NO: 2677 - RNA, 22 nt, Artificial Sequence
  Synthetic Construct
auacagccugcauucccguuuu

SEQ ID NO: 2678 - RNA, 23 nt, Artificial Sequence
  Synthetic Construct
accaggcuccaggaacucagauu

SEQ ID NO: 2679 - RNA, 23 nt, Artificial Sequence
  Synthetic Construct
cgggcgagcacuggaucuccauu

SEQ ID NO: 2680 - RNA, 22 nt, Artificial Sequence
  Synthetic Construct
uguugcaagucgguggagacgu

SEQ ID NO: 2681 - RNA, 22 nt, Artificial Sequence
  Synthetic Construct
ucucccuuccugcccuggcuag

SEQ ID NO: 2682 - RNA, 23 nt, Artificial Sequence
  Synthetic Construct
caccagaaagcccagcagauauu

SEQ ID NO: 2683 - RNA, 22 nt, Artificial Sequence
  Synthetic Construct
cagcccuccucccgcacccaaa

SEQ ID NO: 2684 - RNA, 22 nt, Artificial Sequence
  Synthetic Construct
cagguccucugcugccccuauu

SEQ ID NO: 2685 - RNA, 22 nt, Artificial Sequence
  Synthetic Construct
cccccaccaugucuccucaauu

SEQ ID NO: 2686 - RNA, 22 nt, Artificial Sequence
  Synthetic Construct
gagcaggcgaggcugggcugaa

SEQ ID NO: 2687 - RNA, 23 nt, Artificial Sequence
  Synthetic Construct
ccagccacggacugagagugcau

SEQ ID NO: 2688 - RNA, 22 nt, Artificial Sequence
  Synthetic Construct
cugauacccacacugccugauu

SEQ ID NO: 2689 - RNA, 23 nt, Artificial Sequence
  Synthetic Construct
ugagaguggaauucacaguauuu

SEQ ID NO: 2690 - RNA, 21 nt, Artificial Sequence
  Synthetic Construct
caaauggacaggauaacaccu

SEQ ID NO: 2691 - RNA, 22 nt, Artificial Sequence
  Synthetic Construct
ugaucucaccgcugccuccuuc

SEQ ID NO: 2692 - RNA, 22 nt, Artificial Sequence
  Synthetic Construct
augacaguauccgucuugcauu

SEQ ID NO: 2693 - RNA, 24 nt, Artificial Sequence
  Synthetic Construct
ugucagugacuccugccccuuggu

SEQ ID NO: 2694 - RNA, 23 nt, Artificial Sequence
  Synthetic Construct
gggucuuccucuacauuuugauu

SEQ ID NO: 2695 - RNA, 22 nt, Artificial Sequence
  Synthetic Construct
agaagauugcagaguaaguucc

SEQ ID NO: 2696 - RNA, 22 nt, Artificial Sequence
  Synthetic Construct
ucuggggaugaggacagugugu

SEQ ID NO: 2697 - RNA, 20 nt, Artificial Sequence
  Synthetic Construct
augggugauggguguggugu

SEQ ID NO: 2698 - RNA, 23 nt, Artificial Sequence
  Synthetic Construct
uagcaauacaguacaaauauagu

SEQ ID NO: 2699 - RNA, 22 nt, Artificial Sequence
  Synthetic Construct
gacacuaggcaugugagugauu

SEQ ID NO: 2700 - RNA, 22 nt, Artificial Sequence
  Synthetic Construct
agcaauuaccaagugauugauu

SEQ ID NO: 2701 - RNA, 25 nt, Artificial Sequence
  Synthetic Construct
gcagcgcccacuuccuccccgcuuu

SEQ ID NO: 2702 - RNA, 23 nt, Artificial Sequence
  Synthetic Construct
gccccggcgcgggcggguucugg

SEQ ID NO: 2703 - RNA, 22 nt, Artificial Sequence
  Synthetic Construct
agcaaggcggcaucucucugau

SEQ ID NO: 2704 - RNA, 23 nt, Artificial Sequence
  Synthetic Construct
uugaagaggaggugcucuguagc

SEQ ID NO: 2705 - RNA, 18 nt, Artificial Sequence
  Synthetic Construct
ccaccugcccucacccuu

SEQ ID NO: 2706 - RNA, 23 nt, Artificial Sequence
  Synthetic Construct
ugcaucaggccagaagacaugag

SEQ ID NO: 2707 - RNA, 22 nt, Artificial Sequence
  Synthetic Construct
uccaguacaggucucucauuuc

SEQ ID NO: 2708 - RNA, 22 nt, Artificial Sequence
  Synthetic Construct
ugggauccagacagugggagaa

SEQ ID NO: 2709 - RNA, 22 nt, Artificial Sequence
  Synthetic Construct
ccaaccuagguggucagaguug

SEQ ID NO: 2710 - RNA, 22 nt, Artificial Sequence
  Synthetic Construct
aaguuggcugcaguuaaggugg

SEQ ID NO: 2711 - RNA, 22 nt, Artificial Sequence
  Synthetic Construct
uccauguuuccuucccccuucu

SEQ ID NO: 2712 - RNA, 22 nt, Artificial Sequence
  Synthetic Construct
uaggccacagccacccaugugu

SEQ ID NO: 2713 - RNA, 21 nt, Artificial Sequence
  Synthetic Construct
cuugguuucagguacagcuuu

SEQ ID NO: 2714 - RNA, 22 nt, Artificial Sequence
  Synthetic Construct
ugcauauuauagauuugugauu

SEQ ID NO: 2715 - RNA, 22 nt, Artificial Sequence
  Synthetic Construct
ccuggcauauuugguauaacuu

SEQ ID NO: 2716 - RNA, 22 nt, Artificial Sequence
  Synthetic Construct
accgucaccuggagcccucauu

SEQ ID NO: 2717 - RNA, 22 nt, Artificial Sequence
  Synthetic Construct
accugccagcaccucccugcag

SEQ ID NO: 2718 - RNA, 22 nt, Artificial Sequence
  Synthetic Construct
cccucucuggcuccuccccaaa

SEQ ID NO: 2719 - RNA, 21 nt, Artificial Sequence
  Synthetic Construct
guaccuucugguucagcuagu

SEQ ID NO: 2720 - RNA, 22 nt, Artificial Sequence
  Synthetic Construct
uggggaaggcgucagugucggg

SEQ ID NO: 2721 - RNA, 23 nt, Artificial Sequence
  Synthetic Construct
agggccagaggagccuggagugg

SEQ ID NO: 2722 - RNA, 21 nt, Artificial Sequence
  Synthetic Construct
aucugccagcuuccacagugg

SEQ ID NO: 2723 - RNA, 23 nt, Artificial Sequence
  Synthetic Construct
ugggaggggagaggcagcaagca

SEQ ID NO: 2724 - RNA, 22 nt, Artificial Sequence
  Synthetic Construct
gcuucccaacagauaaaugauu

SEQ ID NO: 2725 - RNA, 23 nt, Artificial Sequence
  Synthetic Construct
gcauggaaugggcuccgccaguu

SEQ ID NO: 2726 - RNA, 22 nt, Artificial Sequence
  Synthetic Construct
cacacaaguggcccccaacacu

SEQ ID NO: 2727 - RNA, 21 nt, Artificial Sequence
  Synthetic Construct
gcccugaccuguccuguucug

SEQ ID NO: 2728 - RNA, 22 nt, Artificial Sequence
  Synthetic Construct
ccaccaggucuagcauugggau

SEQ ID NO: 2729 - RNA, 22 nt, Artificial Sequence
  Synthetic Construct
cccugaccgcagcccgcagcuu

SEQ ID NO: 2730 - RNA, 21 nt, Artificial Sequence
  Synthetic Construct
aaaggugcucaaauuagacau

SEQ ID NO: 2731 - RNA, 19 nt, Artificial Sequence
  Synthetic Construct
gcccagauaaccugccuuu

SEQ ID NO: 2732 - RNA, 20 nt, Artificial Sequence
  Synthetic Construct
cugucagcauccucgcauuu

SEQ ID NO: 2733 - RNA, 22 nt, Artificial Sequence
  Synthetic Construct
accagcgcguuuucaguuucau

SEQ ID NO: 2734 - RNA, 25 nt, Artificial Sequence
  Synthetic Construct
ggccccuccgcuccuccucccuuuu

SEQ ID NO: 2735 - RNA, 22 nt, Artificial Sequence
  Synthetic Construct
aggacugauccucucgggcagg

SEQ ID NO: 2736 - RNA, 23 nt, Artificial Sequence
  Synthetic Construct
ccgaccccuccggacagcccguu

SEQ ID NO: 2737 - RNA, 23 nt, Artificial Sequence
  Synthetic Construct
ucuguauucuccuuugccugcag

SEQ ID NO: 2738 - RNA, 23 nt, Artificial Sequence
  Synthetic Construct
uggccggaugggacaggaggcau

SEQ ID NO: 2739 - RNA, 23 nt, Artificial Sequence
  Synthetic Construct
uagcgaagucuagucuuuagauu

SEQ ID NO: 2740 - RNA, 23 nt, Artificial Sequence
  Synthetic Construct
uggcccggcgacgucucacgguc

SEQ ID NO: 2741 - RNA, 23 nt, Artificial Sequence
  Synthetic Construct
ccggucccaggagaaccugcaga

SEQ ID NO: 2742 - RNA, 22 nt, Artificial Sequence
  Synthetic Construct
agggaaggaggcuuggucuuag

SEQ ID NO: 2743 - RNA, 21 nt, Artificial Sequence
  Synthetic Construct
caaauccuccccaaaccucuu

SEQ ID NO: 2744 - RNA, 20 nt, Artificial Sequence
  Synthetic Construct
cgccccuccugcccccacag

SEQ ID NO: 2745 - RNA, 22 nt, Artificial Sequence
  Synthetic Construct
cucgggcggaggugguugagug

SEQ ID NO: 2746 - RNA, 24 nt, Artificial Sequence
  Synthetic Construct
uucuagcagcuacggguccucuuu

SEQ ID NO: 2747 - RNA, 22 nt, Artificial Sequence
  Synthetic Construct
cacauccuugagauccacaauu

SEQ ID NO: 2748 - RNA, 22 nt, Artificial Sequence
  Synthetic Construct
uucucuuucuuuagccuugugu

SEQ ID NO: 2749 - RNA, 23 nt, Artificial Sequence
  Synthetic Construct
uccgcuaacccagguccgcauuu

SEQ ID NO: 2750 - RNA, 22 nt, Artificial Sequence
  Synthetic Construct
agccaggcucugaagggaaagu

SEQ ID NO: 2751 - RNA, 23 nt, Artificial Sequence
  Synthetic Construct
cagggaggcgcucacucucugcu

SEQ ID NO: 2752 - RNA, 23 nt, Artificial Sequence
  Synthetic Construct
aggccucugugacgucacggugu

SEQ ID NO: 2753 - RNA, 23 nt, Artificial Sequence
  Synthetic Construct
ugccccaccugcugaccacccuc

SEQ ID NO: 2754 - RNA, 21 nt, Artificial Sequence
  Synthetic Construct
auuccaacaucuaguccuauu

SEQ ID NO: 2755 - RNA, 22 nt, Artificial Sequence
  Synthetic Construct
uuuagauugaacaugaaguuag

SEQ ID NO: 2756 - RNA, 21 nt, Artificial Sequence
  Synthetic Construct
gagggcaugcgcacuuugucc

SEQ ID NO: 2757 - RNA, 22 nt, Artificial Sequence
  Synthetic Construct
cuucugaucaagauuuguggug

SEQ ID NO: 2758 - RNA, 21 nt, Artificial Sequence
  Synthetic Construct
cgccugcccagcccuccugcu

SEQ ID NO: 2759 - RNA, 21 nt, Artificial Sequence
  Synthetic Construct
uggauguggaaggaguuaucu

SEQ ID NO: 2760 - RNA, 22 nt, Artificial Sequence
  Synthetic Construct
acauagcuaucaaucacucauu

SEQ ID NO: 2761 - RNA, 21 nt, Artificial Sequence
  Synthetic Construct
auagcaauugcucuuuuggaa

SEQ ID NO: 2762 - RNA, 23 nt, Artificial Sequence
  Synthetic Construct
cggcggccaggagcgcccgcguu

SEQ ID NO: 2763 - RNA, 22 nt, Artificial Sequence
  Synthetic Construct
auucucucuggaucccauggau

SEQ ID NO: 2764 - RNA, 24 nt, Artificial Sequence
  Synthetic Construct
ggugggauggagagaagguaugag

SEQ ID NO: 2765 - RNA, 18 nt, Artificial Sequence
  Synthetic Construct
cuacagugucaucucauu

SEQ ID NO: 2766 - RNA, 21 nt, Artificial Sequence
  Synthetic Construct
auuguaggucaagucugcuuu

SEQ ID NO: 2767 - RNA, 22 nt, Artificial Sequence
  Synthetic Construct
ugaucaggcaaaauugcagacu

SEQ ID NO: 2768 - RNA, 22 nt, Artificial Sequence
  Synthetic Construct
cuuucuaugcuccuguucuguu

SEQ ID NO: 2769 - RNA, 22 nt, Artificial Sequence
  Synthetic Construct
ucugguauguaguagguaauaa

SEQ ID NO: 2770 - RNA, 22 nt, Artificial Sequence
  Synthetic Construct
ugaccgaaacaaaaaauuaauu

SEQ ID NO: 2771 - RNA, 23 nt, Artificial Sequence
  Synthetic Construct
cuugccauccugguccacugcau

SEQ ID NO: 2772 - RNA, 22 nt, Artificial Sequence
  Synthetic Construct
auaccucaucuagaaugcugua

SEQ ID NO: 2773 - RNA, 22 nt, Artificial Sequence
  Synthetic Construct
aauucuguaaaggaagaagagg

SEQ ID NO: 2774 - RNA, 22 nt, Artificial Sequence
  Synthetic Construct
gcuuuuacuauucccuccuauu

SEQ ID NO: 2775 - RNA, 22 nt, Artificial Sequence
  Synthetic Construct
uagggaucaggcucaaggguuu

SEQ ID NO: 2776 - RNA, 22 nt, Artificial Sequence
  Synthetic Construct
aauguuggaauccucgcuagag

SEQ ID NO: 2777 - RNA, 22 nt, Artificial Sequence
  Synthetic Construct
uucuggauaugaagacaaucaa

SEQ ID NO: 2778 - RNA, 21 nt, Artificial Sequence
  Synthetic Construct
ggcgcgcccagcucccgggcu

SEQ ID NO: 2779 - RNA, 20 nt, Artificial Sequence
  Synthetic Construct
agucccagcaucuccucauu

SEQ ID NO: 2780 - RNA, 21 nt, Artificial Sequence
  Synthetic Construct
uggcggcgucgccgacucuuu

SEQ ID NO: 2781 - RNA, 22 nt, Artificial Sequence
  Synthetic Construct
ugagaccaggacuggaugcacc

SEQ ID NO: 2782 - RNA, 22 nt, Artificial Sequence
  Synthetic Construct
gcggggguggcggcggcauccc

SEQ ID NO: 2783 - RNA, 22 nt, Artificial Sequence
  Synthetic Construct
cucccuuagcugguccguaauu

SEQ ID NO: 2784 - RNA, 21 nt, Artificial Sequence
  Synthetic Construct
cacacauagcagguguauaua

SEQ ID NO: 2785 - RNA, 22 nt, Artificial Sequence
  Synthetic Construct
ugaaugguaaagcgaugucaca

SEQ ID NO: 2786 - RNA, 18 nt, Artificial Sequence
  Synthetic Construct
ucagucaucauauccauu

SEQ ID NO: 2787 - RNA, 18 nt, Artificial Sequence
  Synthetic Construct
cagcgagcgcucaccguu

SEQ ID NO: 2788 - RNA, 23 nt, Artificial Sequence
  Synthetic Construct
ucugcacugugaguuggcuggcu

SEQ ID NO: 2789 - RNA, 22 nt, Artificial Sequence
  Synthetic Construct
agucucgugagauagccagauu

SEQ ID NO: 2790 - RNA, 22 nt, Artificial Sequence
  Synthetic Construct
auauuauuagccacuucuggau

SEQ ID NO: 2791 - RNA, 22 nt, Artificial Sequence
  Synthetic Construct
ugucuauacucugucacuuuac

SEQ ID NO: 2792 - RNA, 21 nt, Artificial Sequence
  Synthetic Construct
ucucaguaaguggcacucugu

SEQ ID NO: 2793 - RNA, 22 nt, Artificial Sequence
  Synthetic Construct
aacucacgaaguauaccgaagu

SEQ ID NO: 2794 - RNA, 22 nt, Artificial Sequence
  Synthetic Construct
acuggcaugcugcauuuauaua

SEQ ID NO: 2795 - RNA, 21 nt, Artificial Sequence
  Synthetic Construct
aguggaccgaggaaggaagga

SEQ ID NO: 2796 - RNA, 22 nt, Artificial Sequence
  Synthetic Construct
agccuugguuuucuuguguauu

SEQ ID NO: 2797 - RNA, 23 nt, Artificial Sequence
  Synthetic Construct
uacauggauggaaaccuucaagc

SEQ ID NO: 2798 - RNA, 21 nt, Artificial Sequence
  Synthetic Construct
aauccacacuauuauguuauu

SEQ ID NO: 2799 - RNA, 21 nt, Artificial Sequence
  Synthetic Construct
uuggacgguaagguuaagcaa

SEQ ID NO: 2800 - RNA, 22 nt, Artificial Sequence
  Synthetic Construct
aagacgggaggaaagaagggag

SEQ ID NO: 2801 - RNA, 22 nt, Artificial Sequence
  Synthetic Construct
cgggaggggacugagccugauu

SEQ ID NO: 2802 - RNA, 22 nt, Artificial Sequence
  Synthetic Construct
gucauacacggcucuccucucu

SEQ ID NO: 2803 - RNA, 22 nt, Artificial Sequence
  Synthetic Construct
uccuguacugagcugccccgag

SEQ ID NO: 2804 - RNA, 22 nt, Artificial Sequence
  Synthetic Construct
aaucauacagggacauccaguu

SEQ ID NO: 2805 - RNA, 22 nt, Artificial Sequence
  Synthetic Construct
aaucguacagggucauccacuu

SEQ ID NO: 2806 - RNA, 21 nt, Artificial Sequence
  Synthetic Construct
cccagauaauggcacucucaa

SEQ ID NO: 2807 - RNA, 22 nt, Artificial Sequence
  Synthetic Construct
ggucguaugugugacgccauuu

SEQ ID NO: 2808 - RNA, 22 nt, Artificial Sequence
  Synthetic Construct
caaccuggaggacuccaugcug

SEQ ID NO: 2809 - RNA, 22 nt, Artificial Sequence
  Synthetic Construct
cuuaugcaagauucccuucuac

SEQ ID NO: 2810 - RNA, 23 nt, Artificial Sequence
  Synthetic Construct
gaaucuugucccgcagguccuuu

SEQ ID NO: 2811 - RNA, 22 nt, Artificial Sequence
  Synthetic Construct
uuguacaugguaggcuuucauu

SEQ ID NO: 2812 - RNA, 22 nt, Artificial Sequence
  Synthetic Construct
ugaaacauacacgggaaaccuc

SEQ ID NO: 2813 - RNA, 22 nt, Artificial Sequence
  Synthetic Construct
aaacaaacauggugcacuucuu

SEQ ID NO: 2814 - RNA, 22 nt, Artificial Sequence
  Synthetic Construct
gauuggccauguaauacucauu

SEQ ID NO: 2815 - RNA, 22 nt, Artificial Sequence
  Synthetic Construct
caaaccacacugugguguuaga

SEQ ID NO: 2816 - RNA, 23 nt, Artificial Sequence
  Synthetic Construct
aaaacgcccccuggcuugaaauu

SEQ ID NO: 2817 - RNA, 20 nt, Artificial Sequence
  Synthetic Construct
ucacuaccugacaauacagu

SEQ ID NO: 2818 - RNA, 22 nt, Artificial Sequence
  Synthetic Construct
aacaucacagcaagucugugcu

SEQ ID NO: 2819 - RNA, 22 nt, Artificial Sequence
  Synthetic Construct
aacaucacugcaagucuuaaca

SEQ ID NO: 2820 - RNA, 22 nt, Artificial Sequence
  Synthetic Construct
caguucagaaguguuccugagu

SEQ ID NO: 2821 - RNA, 22 nt, Artificial Sequence
  Synthetic Construct
uucugccucuguccagguccuu

SEQ ID NO: 2822 - RNA, 24 nt, Artificial Sequence
  Synthetic Construct
aauuugguuucugaggcacuuagu

SEQ ID NO: 2823 - RNA, 21 nt, Artificial Sequence
  Synthetic Construct
uacuuuucuagguuguugggg

SEQ ID NO: 2824 - RNA, 22 nt, Artificial Sequence
  Synthetic Construct
ugaggacagggcaaauucacga

SEQ ID NO: 2825 - RNA, 21 nt, Artificial Sequence
  Synthetic Construct
uuucccuuuccauccuggcag

SEQ ID NO: 2826 - RNA, 22 nt, Artificial Sequence
  Synthetic Construct
aucauaugaaccaaacucuaau

SEQ ID NO: 2827 - RNA, 21 nt, Artificial Sequence
  Synthetic Construct
ccugugcucccagggccucgc

SEQ ID NO: 2828 - RNA, 24 nt, Artificial Sequence
  Synthetic Construct
uuggacuuuuucagauuuggggau

SEQ ID NO: 2829 - RNA, 23 nt, Artificial Sequence
  Synthetic Construct
uaauccuugcuaccugggugaga

SEQ ID NO: 2830 - RNA, 20 nt, Artificial Sequence
  Synthetic Construct
gcacccaggcaaggauucug

SEQ ID NO: 2831 - RNA, 22 nt, Artificial Sequence
  Synthetic Construct
aauccuuugucccugggugaga

SEQ ID NO: 2832 - RNA, 22 nt, Artificial Sequence
  Synthetic Construct
uuuugugucucccauuccccag

SEQ ID NO: 2833 - RNA, 22 nt, Artificial Sequence
  Synthetic Construct
gugcauggcuguauauauaaca

SEQ ID NO: 2834 - RNA, 21 nt, Artificial Sequence
  Synthetic Construct
auccuugcuaucugggugcua

SEQ ID NO: 2835 - RNA, 23 nt, Artificial Sequence
  Synthetic Construct
gggguauuguuuccgcugccagg

SEQ ID NO: 2836 - RNA, 22 nt, Artificial Sequence
  Synthetic Construct
agacccuggucugcacucuauc

SEQ ID NO: 2837 - RNA, 21 nt, Artificial Sequence
  Synthetic Construct
cuuacaaccgcagcugcaauu

SEQ ID NO: 2838 - RNA, 22 nt, Artificial Sequence
  Synthetic Construct
gggagccaggaaguauugaugu

SEQ ID NO: 2839 - RNA, 22 nt, Artificial Sequence
  Synthetic Construct
uauucaggaagguguuacuuaa

SEQ ID NO: 2840 - RNA, 21 nt, Artificial Sequence
  Synthetic Construct
cacuccaaaaggugcaaaauu

SEQ ID NO: 2841 - RNA, 23 nt, Artificial Sequence
  Synthetic Construct
uacuccagagggcgucacucaug

SEQ ID NO: 2842 - RNA, 23 nt, Artificial Sequence
  Synthetic Construct
ugccagcaaagcuacaaacccuu

SEQ ID NO: 2843 - RNA, 24 nt, Artificial Sequence
  Synthetic Construct
cagggcucagggauuggauggagg

SEQ ID NO: 2844 - RNA, 23 nt, Artificial Sequence
  Synthetic Construct
augcuacucggaaaucccacuga

SEQ ID NO: 2845 - RNA, 21 nt, Artificial Sequence
  Synthetic Construct
uacugcagacaguggcaauca

SEQ ID NO: 2846 - RNA, 22 nt, Artificial Sequence
  Synthetic Construct
uacugcagacguggcaaucaug

SEQ ID NO: 2847 - RNA, 23 nt, Artificial Sequence
  Synthetic Construct
cccuacaccaaucugccccgguu

SEQ ID NO: 2848 - RNA, 23 nt, Artificial Sequence
  Synthetic Construct
gcacagucuugucgucuccguuu

SEQ ID NO: 2849 - RNA, 22 nt, Artificial Sequence
  Synthetic Construct
ugccaagcucagcguggauuuu

SEQ ID NO: 2850 - RNA, 23 nt, Artificial Sequence
  Synthetic Construct
uccuagccagccucauuuccuuu

SEQ ID NO: 2851 - RNA, 22 nt, Artificial Sequence
  Synthetic Construct
guucaaggcauucacugauuuu

SEQ ID NO: 2852 - RNA, 21 nt, Artificial Sequence
  Synthetic Construct
cggugguucacgccuguaauu

SEQ ID NO: 2853 - RNA, 21 nt, Artificial Sequence
  Synthetic Construct
cugaccaacauggugaaacuu

SEQ ID NO: 2854 - RNA, 21 nt, Artificial Sequence
  Synthetic Construct
auugaaaccucuaagagugga

SEQ ID NO: 2855 - RNA, 22 nt, Artificial Sequence
  Synthetic Construct
aggcaccgcugggaucugaauu

SEQ ID NO: 2856 - RNA, 20 nt, Artificial Sequence
  Synthetic Construct
aauguguagcaaaagacaga

SEQ ID NO: 2857 - RNA, 23 nt, Artificial Sequence
  Synthetic Construct
cacucagccuugagggcacuuuc

SEQ ID NO: 2858 - RNA, 18 nt, Artificial Sequence
  Synthetic Construct
uucacagggaggugucau

SEQ ID NO: 2859 - RNA, 22 nt, Artificial Sequence
  Synthetic Construct
uucacaaggaggugucauuuau

SEQ ID NO: 2860 - RNA, 23 nt, Artificial Sequence
  Synthetic Construct
uaaauuucaccuuucugagaaga

SEQ ID NO: 2861 - RNA, 23 nt, Artificial Sequence
  Synthetic Construct
uacucuggagagugacaaucaug

SEQ ID NO: 2862 - RNA, 22 nt, Artificial Sequence
  Synthetic Construct
uucucaagagggaggcaaucau

SEQ ID NO: 2863 - RNA, 24 nt, Artificial Sequence
  Synthetic Construct
uucuccaaaagaaagcacuuucug

SEQ ID NO: 2864 - RNA, 18 nt, Artificial Sequence
  Synthetic Construct
ugcuuccuuucagagggu

SEQ ID NO: 2865 - RNA, 18 nt, Artificial Sequence
  Synthetic Construct
ugcuuccuuucagagggu

SEQ ID NO: 2866 - RNA, 22 nt, Artificial Sequence
  Synthetic Construct
ccucuagauggaagcacugucu

SEQ ID NO: 2867 - RNA, 22 nt, Artificial Sequence
  Synthetic Construct
ccucuagauggaagcacugucu

SEQ ID NO: 2868 - RNA, 22 nt, Artificial Sequence
  Synthetic Construct
ccucuagauggaagcacugucu

SEQ ID NO: 2869 - RNA, 21 nt, Artificial Sequence
  Synthetic Construct
cugauuucuaccaaucucuuu

SEQ ID NO: 2870 - RNA, 22 nt, Artificial Sequence
  Synthetic Construct
ugggaugagggauugaagugga

SEQ ID NO: 2871 - RNA, 23 nt, Artificial Sequence
  Synthetic Construct
ccgguuuaaauggguccgauuuu

SEQ ID NO: 2872 - RNA, 21 nt, Artificial Sequence
  Synthetic Construct
ugccaaccgucagagcccaga

SEQ ID NO: 2873 - RNA, 20 nt, Artificial Sequence
  Synthetic Construct
cugcaaagggaagcccuuuc

SEQ ID NO: 2874 - RNA, 22 nt, Artificial Sequence
  Synthetic Construct
cucuaaaggggagcgcuuuguu

SEQ ID NO: 2875 - RNA, 23 nt, Artificial Sequence
  Synthetic Construct
ucucuggagggaagcacuuucug

SEQ ID NO: 2876 - RNA, 21 nt, Artificial Sequence
  Synthetic Construct
caaagcgcuucccuuuggagc

SEQ ID NO: 2877 - RNA, 21 nt, Artificial Sequence
  Synthetic Construct
aaagcgcuucccuucagagug

SEQ ID NO: 2878 - RNA, 21 nt, Artificial Sequence
  Synthetic Construct
gaaagcgcuucucuuuagagg

SEQ ID NO: 2879 - RNA, 21 nt, Artificial Sequence
  Synthetic Construct
gcuccagcucagucacugguu

SEQ ID NO: 2880 - RNA, 22 nt, Artificial Sequence
  Synthetic Construct
cacuucauucuuccuauccuuu

SEQ ID NO: 2881 - RNA, 22 nt, Artificial Sequence
  Synthetic Construct
caccuggaauccacucuccuuu

SEQ ID NO: 2882 - RNA, 22 nt, Artificial Sequence
  Synthetic Construct
ugggaugagguagaggaggauu

SEQ ID NO: 2883 - RNA, 22 nt, Artificial Sequence
  Synthetic Construct
aucccauuccaaaccccucauu

SEQ ID NO: 2884 - RNA, 21 nt, Artificial Sequence
  Synthetic Construct
auccaguucucugagggggcu

SEQ ID NO: 2885 - RNA, 21 nt, Artificial Sequence
  Synthetic Construct
ucauccucgucucccucccag

SEQ ID NO: 2886 - RNA, 23 nt, Artificial Sequence
  Synthetic Construct
caauggcacaaacucauucuuga

SEQ ID NO: 2887 - RNA, 22 nt, Artificial Sequence
  Synthetic Construct
aaagugcauccuuuuagagugu

SEQ ID NO: 2888 - RNA, 22 nt, Artificial Sequence
  Synthetic Construct
cucuagagggaagcgcuuucug

SEQ ID NO: 2889 - RNA, 22 nt, Artificial Sequence
  Synthetic Construct
cucuagagggaagcgcuuucug

SEQ ID NO: 2890 - RNA, 25 nt, Artificial Sequence
  Synthetic Construct
ccuccaaagggaagcgcuuucuguu

SEQ ID NO: 2891 - RNA, 22 nt, Artificial Sequence
  Synthetic Construct
aagugccuccuuuuagaguguu

SEQ ID NO: 2892 - RNA, 21 nt, Artificial Sequence
  Synthetic Construct
cuccagagggaaguacuuucu

SEQ ID NO: 2893 - RNA, 21 nt, Artificial Sequence
  Synthetic Construct
cucuaaaaggaagcacuuuuu

SEQ ID NO: 2894 - RNA, 22 nt, Artificial Sequence
  Synthetic Construct
aaagugcuuccuuuuagagggu

SEQ ID NO: 2895 - RNA, 22 nt, Artificial Sequence
  Synthetic Construct
aaagugcuucucuuuggugggu

SEQ ID NO: 2896 - RNA, 21 nt, Artificial Sequence
  Synthetic Construct
cucaaaaaggaagcacuuuuu

SEQ ID NO: 2897 - RNA, 22 nt, Artificial Sequence
  Synthetic Construct
aagugcuuccuuuuagaggguu

SEQ ID NO: 2898 - RNA, 24 nt, Artificial Sequence
  Synthetic Construct
acaaagugcuucccuuuagagugu

SEQ ID NO: 2899 - RNA, 22 nt, Artificial Sequence
  Synthetic Construct
ucuaaagggaagcacuuuguuu

SEQ ID NO: 2900 - RNA, 22 nt, Artificial Sequence
  Synthetic Construct
acucuaaagggaagugcguuuu

SEQ ID NO: 2901 - RNA, 22 nt, Artificial Sequence
  Synthetic Construct
aaaaugguucccuuuagagugu

SEQ ID NO: 2902 - RNA, 23 nt, Artificial Sequence
  Synthetic Construct
gaacgcgcuucccuauagagggu

SEQ ID NO: 2903 - RNA, 22 nt, Artificial Sequence
  Synthetic Construct
cuacaaagggaagcacuuucuc

SEQ ID NO: 2904 - RNA, 22 nt, Artificial Sequence
  Synthetic Construct
gaaggcgcuucccuuuagagcg

SEQ ID NO: 2905 - RNA, 22 nt, Artificial Sequence
  Synthetic Construct
gaaagugcuucccucuagaguu

SEQ ID NO: 2906 - RNA, 23 nt, Artificial Sequence
  Synthetic Construct
cucuugagggaagcacuuucugu

SEQ ID NO: 2907 - RNA, 20 nt, Artificial Sequence
  Synthetic Construct
aagggcuucccuuugcaguu

SEQ ID NO: 2908 - RNA, 22 nt, Artificial Sequence
  Synthetic Construct
caugccuugaguguaggaccgu

SEQ ID NO: 2909 - RNA, 22 nt, Artificial Sequence
  Synthetic Construct
aucauacaaggacaauuucuuu

SEQ ID NO: 2910 - RNA, 25 nt, Artificial Sequence
  Synthetic Construct
aaaggauucugcugucggucccacu

SEQ ID NO: 2911 - RNA, 23 nt, Artificial Sequence
  Synthetic Construct
ucggggaucaucaugucacgaga

SEQ ID NO: 2912 - RNA, 22 nt, Artificial Sequence
  Synthetic Construct
gaagugcaccgcgaauguuuuu

SEQ ID NO: 2913 - RNA, 22 nt, Artificial Sequence
  Synthetic Construct
acuugcuaaaaaugcagaauuu

SEQ ID NO: 2914 - RNA, 22 nt, Artificial Sequence
  Synthetic Construct
agaaaugcacaaccucagguuu

SEQ ID NO: 2915 - RNA, 22 nt, Artificial Sequence
  Synthetic Construct
ucagcaaacauuuauugugugc

SEQ ID NO: 2916 - RNA, 22 nt, Artificial Sequence
  Synthetic Construct
aaaaguaauugcgaguuuuacc

SEQ ID NO: 2917 - RNA, 25 nt, Artificial Sequence
  Synthetic Construct
gugcaaaaguaauugugguuuuuuu

SEQ ID NO: 2918 - RNA, 22 nt, Artificial Sequence
  Synthetic Construct
caaaauccacaauuacuuuuuu

SEQ ID NO: 2919 - RNA, 22 nt, Artificial Sequence
  Synthetic Construct
aaaguaauugccgguuuuuguu

SEQ ID NO: 2920 - RNA, 22 nt, Artificial Sequence
  Synthetic Construct
gaaaacgacaaugacuuuugca

SEQ ID NO: 2921 - RNA, 20 nt, Artificial Sequence
  Synthetic Construct
aaaaguaauugugguuuuug

SEQ ID NO: 2922 - RNA, 21 nt, Artificial Sequence
  Synthetic Construct
agaaaccacaauuaccuuuuu

SEQ ID NO: 2923 - RNA, 20 nt, Artificial Sequence
  Synthetic Construct
aaaagugauugcaguguuug

SEQ ID NO: 2924 - RNA, 22 nt, Artificial Sequence
  Synthetic Construct
gaaaaacugcaauuaccuuuuu

SEQ ID NO: 2925 - RNA, 21 nt, Artificial Sequence
  Synthetic Construct
uaaaaacugcaauuacuuuua

SEQ ID NO: 2926 - RNA, 21 nt, Artificial Sequence
  Synthetic Construct
aaaaaccgcaguuacuuuuuu

SEQ ID NO: 2927 - RNA, 22 nt, Artificial Sequence
  Synthetic Construct
guacaaaagucauugccguuuu

SEQ ID NO: 2928 - RNA, 22 nt, Artificial Sequence
  Synthetic Construct
caaaaacugcaguuacuuuugu

SEQ ID NO: 2929 - RNA, 20 nt, Artificial Sequence
  Synthetic Construct
aaaaccacaaugccuuuuuu

SEQ ID NO: 2930 - RNA, 22 nt, Artificial Sequence
  Synthetic Construct
aaagaccgugacuacuuuugca

SEQ ID NO: 2931 - RNA, 19 nt, Artificial Sequence
  Synthetic Construct
aaaaaccacaauuacuuuu

SEQ ID NO: 2932 - RNA, 22 nt, Artificial Sequence
  Synthetic Construct
caaaaacugcaauuacuuuugc

SEQ ID NO: 2933 - RNA, 21 nt, Artificial Sequence
  Synthetic Construct
uaaaacugcaguuauuuuugc

SEQ ID NO: 2934 - RNA, 22 nt, Artificial Sequence
  Synthetic Construct
aaaaguaauugcggguuuugcc

SEQ ID NO: 2935 - RNA, 21 nt, Artificial Sequence
  Synthetic Construct
caaaaccgcaguaacuuuugu

SEQ ID NO: 2936 - RNA, 21 nt, Artificial Sequence
  Synthetic Construct
aaaaguaauugcgguuuuugc

SEQ ID NO: 2937 - RNA, 18 nt, Artificial Sequence
  Synthetic Construct
aaaaguacuugcggauuu

SEQ ID NO: 2938 - RNA, 20 nt, Artificial Sequence
  Synthetic Construct
ccgugaugacuuuugcacuu

SEQ ID NO: 2939 - RNA, 22 nt, Artificial Sequence
  Synthetic Construct
gcaaaaccgcaauuacuucuuu

SEQ ID NO: 2940 - RNA, 21 nt, Artificial Sequence
  Synthetic Construct
aaaaguaauugugguuuuugc

SEQ ID NO: 2941 - RNA, 22 nt, Artificial Sequence
  Synthetic Construct
caaaagugauugugguuuuugc

SEQ ID NO: 2942 - RNA, 22 nt, Artificial Sequence
  Synthetic Construct
caagaaccucaguugcuuuugu

SEQ ID NO: 2943 - RNA, 22 nt, Artificial Sequence
  Synthetic Construct
caaaaaucacaguuaccuuuuu

SEQ ID NO: 2944 - RNA, 22 nt, Artificial Sequence
  Synthetic Construct
caaaaaccauaguuacuuuugc

SEQ ID NO: 2945 - RNA, 22 nt, Artificial Sequence
  Synthetic Construct
caaaaaucucaauuacuuuugc

SEQ ID NO: 2946 - RNA, 22 nt, Artificial Sequence
  Synthetic Construct
aaaaguaauugugguuuuugcc

SEQ ID NO: 2947 - RNA, 22 nt, Artificial Sequence
  Synthetic Construct
caaaagcaaucgcgguuuuugc

SEQ ID NO: 2948 - RNA, 22 nt, Artificial Sequence
  Synthetic Construct
ugcaaaaguaaucacaguuuuu

SEQ ID NO: 2949 - RNA, 22 nt, Artificial Sequence
  Synthetic Construct
aaaacuguaauuacuuuuguac

SEQ ID NO: 2950 - RNA, 22 nt, Artificial Sequence
  Synthetic Construct
aaaaguaaucgcgguuuuuguc

SEQ ID NO: 2951 - RNA, 22 nt, Artificial Sequence
  Synthetic Construct
caaaauccgcaauuacuuuuuu

SEQ ID NO: 2952 - RNA, 22 nt, Artificial Sequence
  Synthetic Construct
aaaaguaauugcggucuuuggu

SEQ ID NO: 2953 - RNA, 22 nt, Artificial Sequence
  Synthetic Construct
caaaauccgcaaguacuuuuuu

SEQ ID NO: 2954 - RNA, 22 nt, Artificial Sequence
  Synthetic Construct
caaaacccgcaaauacuuuuuu

SEQ ID NO: 2955 - RNA, 21 nt, Artificial Sequence
  Synthetic Construct
aaaaccacaaauaccuuuguu

SEQ ID NO: 2956 - RNA, 22 nt, Artificial Sequence
  Synthetic Construct
aaaauccacaauuacuuuuguu

SEQ ID NO: 2957 - RNA, 22 nt, Artificial Sequence
  Synthetic Construct
aaaaguaauugcgguuuuugcc

SEQ ID NO: 2958 - RNA, 22 nt, Artificial Sequence
  Synthetic Construct
aguaacugcaguuuuugcuauu

SEQ ID NO: 2959 - RNA, 22 nt, Artificial Sequence
  Synthetic Construct
gccauuacuuuugcaccagcuu

SEQ ID NO: 2960 - RNA, 23 nt, Artificial Sequence
  Synthetic Construct
aauaacugcaguuuuggccauuu

SEQ ID NO: 2961 - RNA, 21 nt, Artificial Sequence
  Synthetic Construct
caaaagugaucgugguuuuug

SEQ ID NO: 2962 - RNA, 23 nt, Artificial Sequence
  Synthetic Construct
caaaaguaauugcagucuuuguu

SEQ ID NO: 2963 - RNA, 22 nt, Artificial Sequence
  Synthetic Construct
gugcaaaaguaacuguagcuuu

SEQ ID NO: 2964 - RNA, 23 nt, Artificial Sequence
  Synthetic Construct
gcaaaaaccgcaguuacuuuuuu

SEQ ID NO: 2965 - RNA, 20 nt, Artificial Sequence
  Synthetic Construct
uaaaaacugcaauuacuuuc

SEQ ID NO: 2966 - RNA, 22 nt, Artificial Sequence
  Synthetic Construct
caaaaacagugauuacuuuuuu

SEQ ID NO: 2967 - RNA, 23 nt, Artificial Sequence
  Synthetic Construct
caaaaguaauugcgguuuuuguu

SEQ ID NO: 2968 - RNA, 21 nt, Artificial Sequence
  Synthetic Construct
agcucauccauaguugucauu

SEQ ID NO: 2969 - RNA, 23 nt, Artificial Sequence
  Synthetic Construct
agugccugagggaguaagagccc

SEQ ID NO: 2970 - RNA, 20 nt, Artificial Sequence
  Synthetic Construct
agugccugagggaguaagag

SEQ ID NO: 2971 - RNA, 22 nt, Artificial Sequence
  Synthetic Construct
augugccugagggaguaagaca

SEQ ID NO: 2972 - RNA, 21 nt, Artificial Sequence
  Synthetic Construct
gaaaccaagagugggucgcuu

SEQ ID NO: 2973 - RNA, 21 nt, Artificial Sequence
  Synthetic Construct
gcgacccauacuugguuucag

SEQ ID NO: 2974 - RNA, 21 nt, Artificial Sequence
  Synthetic Construct
aacaggugacugguuagacaa

SEQ ID NO: 2975 - RNA, 21 nt, Artificial Sequence
  Synthetic Construct
aacaaaaucucaccguuuuuu

SEQ ID NO: 2976 - RNA, 21 nt, Artificial Sequence
  Synthetic Construct
uggcugagucaggacuagcuu

SEQ ID NO: 2977 - RNA, 21 nt, Artificial Sequence
  Synthetic Construct
cagagguucagcuuacccuuu

SEQ ID NO: 2978 - RNA, 22 nt, Artificial Sequence
  Synthetic Construct
auauuaccauuagcucaucuuu

SEQ ID NO: 2979 - RNA, 23 nt, Artificial Sequence
  Synthetic Construct
acaaggcccacccgugcaaacuu

SEQ ID NO: 2980 - RNA, 21 nt, Artificial Sequence
  Synthetic Construct
caauucucaaaggagccuccc

SEQ ID NO: 2981 - RNA, 21 nt, Artificial Sequence
  Synthetic Construct
cagaccccugcaccccaacuu

SEQ ID NO: 2982 - RNA, 22 nt, Artificial Sequence
  Synthetic Construct
uuagcuuaaggaguaccagauc

SEQ ID NO: 2983 - RNA, 19 nt, Artificial Sequence
  Synthetic Construct
uuugguacagcagcucauu

SEQ ID NO: 2984 - RNA, 22 nt, Artificial Sequence
  Synthetic Construct
ugcuggcucauuucauaugugu

SEQ ID NO: 2985 - RNA, 22 nt, Artificial Sequence
  Synthetic Construct
uuccaugccuccuagaaguucc

SEQ ID NO: 2986 - RNA, 22 nt, Artificial Sequence
  Synthetic Construct
uaggcacacuuaaaguuauagc

SEQ ID NO: 2987 - RNA, 22 nt, Artificial Sequence
  Synthetic Construct
aaacuaauauacccauauucug

SEQ ID NO: 2988 - RNA, 22 nt, Artificial Sequence
  Synthetic Construct
uaguucuucccuuugcccaauu

SEQ ID NO: 2989 - RNA, 22 nt, Artificial Sequence
  Synthetic Construct
ugaaguaccagcuacucgagag

SEQ ID NO: 2990 - RNA, 22 nt, Artificial Sequence
  Synthetic Construct
cagagugacaagcugguuaaag

SEQ ID NO: 2991 - RNA, 21 nt, Artificial Sequence
  Synthetic Construct
gccccgggcagugugaucauc

SEQ ID NO: 2992 - RNA, 19 nt, Artificial Sequence
  Synthetic Construct
aagucccacuaaugccagc

SEQ ID NO: 2993 - RNA, 23 nt, Artificial Sequence
  Synthetic Construct
ugcacauggcaaccuagcuccca

SEQ ID NO: 2994 - RNA, 21 nt, Artificial Sequence
  Synthetic Construct
uuggugcauauuuacuuuauu

SEQ ID NO: 2995 - RNA, 21 nt, Artificial Sequence
  Synthetic Construct
uugccauacauagacuuuauu

SEQ ID NO: 2996 - RNA, 21 nt, Artificial Sequence
  Synthetic Construct
auacccauagcuuagcuccca

SEQ ID NO: 2997 - RNA, 22 nt, Artificial Sequence
  Synthetic Construct
aucaaggaucuuaaacuuugcc

SEQ ID NO: 2998 - RNA, 20 nt, Artificial Sequence
  Synthetic Construct
aaaugguacagcuacuuuuu

SEQ ID NO: 2999 - RNA, 19 nt, Artificial Sequence
  Synthetic Construct
gaaacguaugucaaccuuu

SEQ ID NO: 3000 - RNA, 19 nt, Artificial Sequence
  Synthetic Construct
cugcugacaccgugccuuu

SEQ ID NO: 3001 - RNA, 19 nt, Artificial Sequence
  Synthetic Construct
ugggaucacaggcgcccuu

SEQ ID NO: 3002 - RNA, 23 nt, Artificial Sequence
  Synthetic Construct
ucuguccuggaagaacauacuuu

SEQ ID NO: 3003 - RNA, 20 nt, Artificial Sequence
  Synthetic Construct
guguauacauuuauacauuu

SEQ ID NO: 3004 - RNA, 22 nt, Artificial Sequence
  Synthetic Construct
agauuaguccagcauuucucuu

SEQ ID NO: 3005 - RNA, 22 nt, Artificial Sequence
  Synthetic Construct
gagguauugccacccuuucuuu

SEQ ID NO: 3006 - RNA, 22 nt, Artificial Sequence
  Synthetic Construct
uagaaaggguggcaauaccuuu

SEQ ID NO: 3007 - RNA, 22 nt, Artificial Sequence
  Synthetic Construct
cuuauccugcaaggugcuacuu

SEQ ID NO: 3008 - RNA, 24 nt, Artificial Sequence
  Synthetic Construct
agucagagaaucugcaucuguauu

SEQ ID NO: 3009 - RNA, 20 nt, Artificial Sequence
  Synthetic Construct
guugcucaggcuagaguuuu

SEQ ID NO: 3010 - RNA, 22 nt, Artificial Sequence
  Synthetic Construct
cgugauaacugcugggcuguuu

SEQ ID NO: 3011 - RNA, 22 nt, Artificial Sequence
  Synthetic Construct
uugacccuaaaacguucuaauu

SEQ ID NO: 3012 - RNA, 22 nt, Artificial Sequence
  Synthetic Construct
uguuuuacagguguuuguuauu

SEQ ID NO: 3013 - RNA, 22 nt, Artificial Sequence
  Synthetic Construct
uaggacuacagguguaugcuuu

SEQ ID NO: 3014 - RNA, 21 nt, Artificial Sequence
  Synthetic Construct
uuuccaggauucauuaacuuu

SEQ ID NO: 3015 - RNA, 21 nt, Artificial Sequence
  Synthetic Construct
uaauagagguaguagcugauu

SEQ ID NO: 3016 - RNA, 22 nt, Artificial Sequence
  Synthetic Construct
uuucucggagcucagagcaauu

SEQ ID NO: 3017 - RNA, 22 nt, Artificial Sequence
  Synthetic Construct
acccacugugguauuauuuguu

SEQ ID NO: 3018 - RNA, 20 nt, Artificial Sequence
  Synthetic Construct
accuacugugauauuauuuu

SEQ ID NO: 3019 - RNA, 22 nt, Artificial Sequence
  Synthetic Construct
acaccuacugugauauuauuuu

SEQ ID NO: 3020 - RNA, 22 nt, Artificial Sequence
  Synthetic Construct
guucauuucagagccacugcuu

SEQ ID NO: 3021 - RNA, 21 nt, Artificial Sequence
  Synthetic Construct
gagacagucccaugaucuguu

SEQ ID NO: 3022 - RNA, 22 nt, Artificial Sequence
  Synthetic Construct
gucuagauucuucuuggaguuu

SEQ ID NO: 3023 - RNA, 22 nt, Artificial Sequence
  Synthetic Construct
caucagacuacuuaaaugaguu

SEQ ID NO: 3024 - RNA, 22 nt, Artificial Sequence
  Synthetic Construct
uuuaucaugaaacuacuugauu

SEQ ID NO: 3025 - RNA, 22 nt, Artificial Sequence
  Synthetic Construct
acaaucacugcacucccccauu

SEQ ID NO: 3026 - RNA, 22 nt, Artificial Sequence
  Synthetic Construct
ugccccaacaaggaaggacaag

SEQ ID NO: 3027 - RNA, 22 nt, Artificial Sequence
  Synthetic Construct
aaagguaauugcaguuuuuccc

SEQ ID NO: 3028 - RNA, 22 nt, Artificial Sequence
  Synthetic Construct
uucaauaauuuaaugcauuauu

SEQ ID NO: 3029 - RNA, 19 nt, Artificial Sequence
  Synthetic Construct
ucagaacgugacaauaauu

SEQ ID NO: 3030 - RNA, 22 nt, Artificial Sequence
  Synthetic Construct
ugggauauguugcugacucauu

SEQ ID NO: 3031 - RNA, 18 nt, Artificial Sequence
  Synthetic Construct
cuucccgacuucuccuuu

SEQ ID NO: 3032 - RNA, 22 nt, Artificial Sequence
  Synthetic Construct
auaaugggaugauggccuaauu

SEQ ID NO: 3033 - RNA, 23 nt, Artificial Sequence
  Synthetic Construct
caggccaugagccccgaaacauu

SEQ ID NO: 3034 - RNA, 22 nt, Artificial Sequence
  Synthetic Construct
cuucagcauguuauccagaauu

SEQ ID NO: 3035 - RNA, 22 nt, Artificial Sequence
  Synthetic Construct
cuuguacagcauucaaacguuu

SEQ ID NO: 3036 - RNA, 20 nt, Artificial Sequence
  Synthetic Construct
ucaggcacagucgcucauuu

SEQ ID NO: 3037 - RNA, 21 nt, Artificial Sequence
  Synthetic Construct
cacucagauggccaacucauu

SEQ ID NO: 3038 - RNA, 20 nt, Artificial Sequence
  Synthetic Construct
ggccaccgccgagcggacuu

SEQ ID NO: 3039 - RNA, 24 nt, Artificial Sequence
  Synthetic Construct
gaucaguuacacaucacuucaguu

SEQ ID NO: 3040 - RNA, 20 nt, Artificial Sequence
  Synthetic Construct
uccccauucucucuccgcuu

SEQ ID NO: 3041 - RNA, 22 nt, Artificial Sequence
  Synthetic Construct
cacgcucaugcacacacccaca

SEQ ID NO: 3042 - RNA, 19 nt, Artificial Sequence
  Synthetic Construct
uccuguccaacuggcucuu

SEQ ID NO: 3043 - RNA, 22 nt, Artificial Sequence
  Synthetic Construct
auucuaauuucuccacgucuuu

SEQ ID NO: 3044 - RNA, 21 nt, Artificial Sequence
  Synthetic Construct
gguaccaauauuuuaucuauu

SEQ ID NO: 3045 - RNA, 21 nt, Artificial Sequence
  Synthetic Construct
aauccuagagcacaagaaguu

SEQ ID NO: 3046 - RNA, 20 nt, Artificial Sequence
  Synthetic Construct
cuccccgcgccccagcccuu

SEQ ID NO: 3047 - RNA, 22 nt, Artificial Sequence
  Synthetic Construct
ucgcgguuugugccagaugacg

SEQ ID NO: 3048 - RNA, 22 nt, Artificial Sequence
  Synthetic Construct
uugagaaugaugaaucauuagg

SEQ ID NO: 3049 - RNA, 21 nt, Artificial Sequence
  Synthetic Construct
ugaucuagagaacacaagauu

SEQ ID NO: 3050 - RNA, 22 nt, Artificial Sequence
  Synthetic Construct
uaacugguugaacaacugaacc

SEQ ID NO: 3051 - RNA, 21 nt, Artificial Sequence
  Synthetic Construct
aaugggaccuuccucuuuguu

SEQ ID NO: 3052 - RNA, 22 nt, Artificial Sequence
  Synthetic Construct
ucaguuccaggccaaccaggcu

SEQ ID NO: 3053 - RNA, 22 nt, Artificial Sequence
  Synthetic Construct
cuagcacacagauacgcccaga

SEQ ID NO: 3054 - RNA, 22 nt, Artificial Sequence
  Synthetic Construct
accuaaaaauacaaugcauauu

SEQ ID NO: 3055 - RNA, 21 nt, Artificial Sequence
  Synthetic Construct
gacucaucaccuauggaaauu

SEQ ID NO: 3056 - RNA, 21 nt, Artificial Sequence
  Synthetic Construct
ucuaacccauuguggccaauu

SEQ ID NO: 3057 - RNA, 22 nt, Artificial Sequence
  Synthetic Construct
ugagaaccacgucugcucugag

SEQ ID NO: 3058 - RNA, 21 nt, Artificial Sequence
  Synthetic Construct
uaauuuuauguauaagcuagu

SEQ ID NO: 3059 - RNA, 20 nt, Artificial Sequence
  Synthetic Construct
aaugagaacccauggucuuu

SEQ ID NO: 3060 - RNA, 22 nt, Artificial Sequence
  Synthetic Construct
aucaucgcauauugacacaauu

SEQ ID NO: 3061 - RNA, 25 nt, Artificial Sequence
  Synthetic Construct
aggcaccagccaggcauugcucagc

SEQ ID NO: 3062 - RNA, 21 nt, Artificial Sequence
  Synthetic Construct
acacaccacggcacacuucuu

SEQ ID NO: 3063 - RNA, 21 nt, Artificial Sequence
  Synthetic Construct
cgaggagccgggcaggcuuuu

SEQ ID NO: 3064 - RNA, 22 nt, Artificial Sequence
  Synthetic Construct
ugugucacucgaugaccacugu

SEQ ID NO: 3065 - RNA, 23 nt, Artificial Sequence
  Synthetic Construct
gcggugaucccgauggugugagc

SEQ ID NO: 3066 - RNA, 20 nt, Artificial Sequence
  Synthetic Construct
uugauaaacugacacaacuu

SEQ ID NO: 3067 - RNA, 23 nt, Artificial Sequence
  Synthetic Construct
gcaaggcucuugucuguaaguuu

SEQ ID NO: 3068 - RNA, 22 nt, Artificial Sequence
  Synthetic Construct
ccuccaacaauccuagaccauu

SEQ ID NO: 3069 - RNA, 23 nt, Artificial Sequence
  Synthetic Construct
gccgcagcugucgcccgugucuu

SEQ ID NO: 3070 - RNA, 22 nt, Artificial Sequence
  Synthetic Construct
aaaaguaauugcaguguguguu

SEQ ID NO: 3071 - RNA, 19 nt, Artificial Sequence
  Synthetic Construct
ccugaauuccgcagccuuu

SEQ ID NO: 3072 - RNA, 23 nt, Artificial Sequence
  Synthetic Construct
uaaaucccauggugccuucuccu

SEQ ID NO: 3073 - RNA, 21 nt, Artificial Sequence
  Synthetic Construct
cuuugauuuucaguaguuuuu

SEQ ID NO: 3074 - RNA, 21 nt, Artificial Sequence
  Synthetic Construct
accgccggagacucgcagguu

SEQ ID NO: 3075 - RNA, 21 nt, Artificial Sequence
  Synthetic Construct
gggcagcaggcccuagcccuu

SEQ ID NO: 3076 - RNA, 21 nt, Artificial Sequence
  Synthetic Construct
uauagaucuggauuugaacuu

SEQ ID NO: 3077 - RNA, 19 nt, Artificial Sequence
  Synthetic Construct
ccagggacuggaaccgguu

SEQ ID NO: 3078 - RNA, 19 nt, Artificial Sequence
  Synthetic Construct
cuuggccggcagcagaauu

SEQ ID NO: 3079 - RNA, 22 nt, Artificial Sequence
  Synthetic Construct
aaggugcagugugaugaggauu

SEQ ID NO: 3080 - RNA, 20 nt, Artificial Sequence
  Synthetic Construct
agcugauaacucacuaccuu

SEQ ID NO: 3081 - RNA, 20 nt, Artificial Sequence
  Synthetic Construct
accuagccucugaauaucuu

SEQ ID NO: 3082 - RNA, 21 nt, Artificial Sequence
  Synthetic Construct
ccaaugccgccugggccguuu

SEQ ID NO: 3083 - RNA, 21 nt, Artificial Sequence
  Synthetic Construct
accucuccucugucaugcuuu

SEQ ID NO: 3084 - RNA, 21 nt, Artificial Sequence
  Synthetic Construct
aggccguacagcucuucccuu

SEQ ID NO: 3085 - RNA, 19 nt, Artificial Sequence
  Synthetic Construct
acagcuagcucaggcgguu

SEQ ID NO: 3086 - RNA, 24 nt, Artificial Sequence
  Synthetic Construct
gcuaguugguccaagcuuccaauu

SEQ ID NO: 3087 - RNA, 25 nt, Artificial Sequence
  Synthetic Construct
ggagcugucccaacaccaccccuuu

SEQ ID NO: 3088 - RNA, 19 nt, Artificial Sequence
  Synthetic Construct
ggaacgcccgcacuagauu

SEQ ID NO: 3089 - RNA, 24 nt, Artificial Sequence
  Synthetic Construct
cgccuuggccggcacugcuccuuu

SEQ ID NO: 3090 - RNA, 19 nt, Artificial Sequence
  Synthetic Construct
aucaaccagacguauucuu

SEQ ID NO: 3091 - RNA, 20 nt, Artificial Sequence
  Synthetic Construct
cacagccucugauauaaguu

SEQ ID NO: 3092 - RNA, 20 nt, Artificial Sequence
  Synthetic Construct
ggccaccgacuggcggaauu

SEQ ID NO: 3093 - RNA, 19 nt, Artificial Sequence
  Synthetic Construct
ugcucccccagccccuuuu

SEQ ID NO: 3094 - RNA, 20 nt, Artificial Sequence
  Synthetic Construct
cugcccuucccaaccuccuu

SEQ ID NO: 3095 - RNA, 18 nt, Artificial Sequence
  Synthetic Construct
ucgcccccccgccucauu

SEQ ID NO: 3096 - RNA, 20 nt, Artificial Sequence
  Synthetic Construct
cccccccgcuucaucucuuu

SEQ ID NO: 3097 - RNA, 24 nt, Artificial Sequence
  Synthetic Construct
gccccgccccaccccggccuccuu

SEQ ID NO: 3098 - RNA, 20 nt, Artificial Sequence
  Synthetic Construct
agaugagagaaacacccuuu

SEQ ID NO: 3099 - RNA, 19 nt, Artificial Sequence
  Synthetic Construct
cccgccccucgcuccccuu

SEQ ID NO: 3100 - RNA, 21 nt, Artificial Sequence
  Synthetic Construct
ccagcacacauuuagcucauu

SEQ ID NO: 3101 - RNA, 23 nt, Artificial Sequence
  Synthetic Construct
cagaccccgagggguccucgcuu

SEQ ID NO: 3102 - RNA, 25 nt, Artificial Sequence
  Synthetic Construct
ggagcucagaagcccugcccagcuu

SEQ ID NO: 3103 - RNA, 20 nt, Artificial Sequence
  Synthetic Construct
cucccccuuccuuuucccuu

SEQ ID NO: 3104 - RNA, 20 nt, Artificial Sequence
  Synthetic Construct
cgccgcuccgccuuccgcuu

SEQ ID NO: 3105 - RNA, 18 nt, Artificial Sequence
  Synthetic Construct
uccgccgggccuucacuu

SEQ ID NO: 3106 - RNA, 19 nt, Artificial Sequence
  Synthetic Construct
ucccacccacucccucauu

SEQ ID NO: 3107 - RNA, 19 nt, Artificial Sequence
  Synthetic Construct
uugacuccaauuccaguuu

SEQ ID NO: 3108 - RNA, 19 nt, Artificial Sequence
  Synthetic Construct
uacacccaacucccucauu

SEQ ID NO: 3109 - RNA, 20 nt, Artificial Sequence
  Synthetic Construct
caaagaaggaacauuccuuu

SEQ ID NO: 3110 - RNA, 19 nt, Artificial Sequence
  Synthetic Construct
uacaauccacucccucauu

SEQ ID NO: 3111 - RNA, 19 nt, Artificial Sequence
  Synthetic Construct
cucccaucugaccagccuu

SEQ ID NO: 3112 - RNA, 19 nt, Artificial Sequence
  Synthetic Construct
caauccccagcccugcuuu

SEQ ID NO: 3113 - RNA, 19 nt, Artificial Sequence
  Synthetic Construct
cccaaccuccucccucauu

SEQ ID NO: 3114 - RNA, 19 nt, Artificial Sequence
  Synthetic Construct
uacauccuaccaccucauu

SEQ ID NO: 3115 - RNA, 23 nt, Artificial Sequence
  Synthetic Construct
accuggcaagaacaggcguucuu

SEQ ID NO: 3116 - RNA, 22 nt, Artificial Sequence
  Synthetic Construct
uccgagccugggucucccucuu

SEQ ID NO: 3117 - RNA, 22 nt, Artificial Sequence
  Synthetic Construct
agucauuggaggguuugagcag

SEQ ID NO: 3118 - RNA, 19 nt, Artificial Sequence
  Synthetic Construct
ccccucaccuccugcuguu

SEQ ID NO: 3119 - RNA, 22 nt, Artificial Sequence
  Synthetic Construct
caccuucaaaugggaagucuuu

SEQ ID NO: 3120 - RNA, 23 nt, Artificial Sequence
  Synthetic Construct
ucagaaggacaaguagaguuuuu

SEQ ID NO: 3121 - RNA, 24 nt, Artificial Sequence
  Synthetic Construct
gaccuggacauguuugugcccagu

SEQ ID NO: 3122 - RNA, 20 nt, Artificial Sequence
  Synthetic Construct
uucuauaucuaucuccauuu

SEQ ID NO: 3123 - RNA, 21 nt, Artificial Sequence
  Synthetic Construct
guaagcgcuguugcuagccuu

SEQ ID NO: 3124 - RNA, 21 nt, Artificial Sequence
  Synthetic Construct
uccaaccucagcagacuguuu

SEQ ID NO: 3125 - RNA, 23 nt, Artificial Sequence
  Synthetic Construct
ccaacagccccugcaagggauuu

SEQ ID NO: 3126 - RNA, 21 nt, Artificial Sequence
  Synthetic Construct
cacaagguauugguauuaccu

SEQ ID NO: 3127 - RNA, 22 nt, Artificial Sequence
  Synthetic Construct
gacuauagaacuuucccccuca

SEQ ID NO: 3128 - RNA, 19 nt, Artificial Sequence
  Synthetic Construct
gacauuuucagacagcuuu

SEQ ID NO: 3129 - RNA, 22 nt, Artificial Sequence
  Synthetic Construct
gugagucucuaagaaaagagga

SEQ ID NO: 3130 - RNA, 22 nt, Artificial Sequence
  Synthetic Construct
augcugacauauuuacuagagg

SEQ ID NO: 3131 - RNA, 22 nt, Artificial Sequence
  Synthetic Construct
guucucccaacguaagcccagc

SEQ ID NO: 3132 - RNA, 22 nt, Artificial Sequence
  Synthetic Construct
cuucccugguacagaauacuuu

SEQ ID NO: 3133 - RNA, 21 nt, Artificial Sequence
  Synthetic Construct
ugaggucugggccaggucuuu

SEQ ID NO: 3134 - RNA, 19 nt, Artificial Sequence
  Synthetic Construct
ccacaggaagcagacacuu

SEQ ID NO: 3135 - RNA, 23 nt, Artificial Sequence
  Synthetic Construct
uauugugguagauacuauuaguu

SEQ ID NO: 3136 - RNA, 22 nt, Artificial Sequence
  Synthetic Construct
ccaaaguuggggugcugguuuu

SEQ ID NO: 3137 - RNA, 23 nt, Artificial Sequence
  Synthetic Construct
acauuguuucagugcccaaguuu

SEQ ID NO: 3138 - RNA, 23 nt, Artificial Sequence
  Synthetic Construct
cgggcgggacgagcaagcacauu

SEQ ID NO: 3139 - RNA, 24 nt, Artificial Sequence
  Synthetic Construct
gcagagcccgaaagcccccaguuu

SEQ ID NO: 3140 - RNA, 25 nt, Artificial Sequence
  Synthetic Construct
gccgccacccgcccgcgaucccuuu

SEQ ID NO: 3141 - RNA, 23 nt, Artificial Sequence
  Synthetic Construct
agcgcucgcaaccgcagcgauuu

SEQ ID NO: 3142 - RNA, 21 nt, Artificial Sequence
  Synthetic Construct
aggcagguuccuggaucauuu

SEQ ID NO: 3143 - RNA, 24 nt, Artificial Sequence
  Synthetic Construct
ggugacucuauccuaugucuuuuu

SEQ ID NO: 3144 - RNA, 22 nt, Artificial Sequence
  Synthetic Construct
agacacauuuggagagggaacc

SEQ ID NO: 3145 - RNA, 22 nt, Artificial Sequence
  Synthetic Construct
agacacauuuggagagggaccc

SEQ ID NO: 3146 - RNA, 22 nt, Artificial Sequence
  Synthetic Construct
accugagcuagcauacaaguuu

SEQ ID NO: 3147 - RNA, 19 nt, Artificial Sequence
  Synthetic Construct
ucuaagaaagccacacuuu

SEQ ID NO: 3148 - RNA, 19 nt, Artificial Sequence
  Synthetic Construct
agcaguaccagccuagauu

SEQ ID NO: 3149 - RNA, 19 nt, Artificial Sequence
  Synthetic Construct
cucagaggcagcugcuuuu

SEQ ID NO: 3150 - RNA, 21 nt, Artificial Sequence
  Synthetic Construct
aggaagugagugcagccacuu

SEQ ID NO: 3151 - RNA, 19 nt, Artificial Sequence
  Synthetic Construct
cagugcccugcacacuuuu

SEQ ID NO: 3152 - RNA, 22 nt, Artificial Sequence
  Synthetic Construct
cucuugaacaacacagguuuuu

SEQ ID NO: 3153 - RNA, 22 nt, Artificial Sequence
  Synthetic Construct
ucgggcgcaagagcacugcagu

SEQ ID NO: 3154 - RNA, 21 nt, Artificial Sequence
  Synthetic Construct
ccugagagcgcugccuccuuu

SEQ ID NO: 3155 - RNA, 24 nt, Artificial Sequence
  Synthetic Construct
aggagcuauccacuccaggugucc

SEQ ID NO: 3156 - RNA, 22 nt, Artificial Sequence
  Synthetic Construct
aguugccagggcugccuuuggu

SEQ ID NO: 3157 - RNA, 21 nt, Artificial Sequence
  Synthetic Construct
uagaccaucuuucuagaguau

SEQ ID NO: 3158 - RNA, 23 nt, Artificial Sequence
  Synthetic Construct
aggucugcauucaaauccccaga

SEQ ID NO: 3159 - RNA, 21 nt, Artificial Sequence
  Synthetic Construct
ucuggcugugcuguaaugcag

SEQ ID NO: 3160 - RNA, 22 nt, Artificial Sequence
  Synthetic Construct
uuggaauaggggauaucucagc

SEQ ID NO: 3161 - RNA, 22 nt, Artificial Sequence
  Synthetic Construct
ucguaucagagauuccagacac

SEQ ID NO: 3162 - RNA, 21 nt, Artificial Sequence
  Synthetic Construct
gaagaauaggagggacuuugu

SEQ ID NO: 3163 - RNA, 22 nt, Artificial Sequence
  Synthetic Construct
ugggccaugcauuucuagaacu

SEQ ID NO: 3164 - RNA, 22 nt, Artificial Sequence
  Synthetic Construct
uuccacugccacuaccuaauuu

SEQ ID NO: 3165 - RNA, 22 nt, Artificial Sequence
  Synthetic Construct
aaaggaaaguguauccuaaaag

SEQ ID NO: 3166 - RNA, 21 nt, Artificial Sequence
  Synthetic Construct
caccgacucugucuccugcag

SEQ ID NO: 3167 - RNA, 22 nt, Artificial Sequence
  Synthetic Construct
ccucaccaucccuucugccugc

SEQ ID NO: 3168 - RNA, 23 nt, Artificial Sequence
  Synthetic Construct
ccucaccaccccuucugccugca

SEQ ID NO: 3169 - RNA, 22 nt, Artificial Sequence
  Synthetic Construct
uuccagcccuucuaaugguagg

SEQ ID NO: 3170 - RNA, 21 nt, Artificial Sequence
  Synthetic Construct
ucaagugucaucugucccuag

SEQ ID NO: 3171 - RNA, 23 nt, Artificial Sequence
  Synthetic Construct
uauggaguggacuuucagcuggc

SEQ ID NO: 3172 - RNA, 21 nt, Artificial Sequence
  Synthetic Construct
uuggaggguguggaagacauc

SEQ ID NO: 3173 - RNA, 22 nt, Artificial Sequence
  Synthetic Construct
aucauguaugauacugcaaaca

SEQ ID NO: 3174 - RNA, 25 nt, Artificial Sequence
  Synthetic Construct
caacccuaggagagggugccauuca

SEQ ID NO: 3175 - RNA, 22 nt, Artificial Sequence
  Synthetic Construct
uucacuggaguuuguuucaaua

SEQ ID NO: 3176 - RNA, 22 nt, Artificial Sequence
  Synthetic Construct
uaugucugcugaccaucaccuu

SEQ ID NO: 3177 - RNA, 22 nt, Artificial Sequence
  Synthetic Construct
auaauacaugguuaaccucuuu

SEQ ID NO: 3178 - RNA, 21 nt, Artificial Sequence
  Synthetic Construct
aauauuauacagucaaccucu

SEQ ID NO: 3179 - RNA, 23 nt, Artificial Sequence
  Synthetic Construct
uagagagggugagaaccugccuu

SEQ ID NO: 3180 - RNA, 25 nt, Artificial Sequence
  Synthetic Construct
caacggaccuacuucccuccgccuu

SEQ ID NO: 3181 - RNA, 22 nt, Artificial Sequence
  Synthetic Construct
cuugguucagggagggucccca

SEQ ID NO: 3182 - RNA, 22 nt, Artificial Sequence
  Synthetic Construct
uacccauugcauaucggaguug

SEQ ID NO: 3183 - RNA, 24 nt, Artificial Sequence
  Synthetic Construct
gcgcaggccagagacccaggcauu

SEQ ID NO: 3184 - RNA, 21 nt, Artificial Sequence
  Synthetic Construct
gcugggccacaacgugggauu

SEQ ID NO: 3185 - RNA, 22 nt, Artificial Sequence
  Synthetic Construct
ggucccgcggcgccccgccuuu

SEQ ID NO: 3186 - RNA, 22 nt, Artificial Sequence
  Synthetic Construct
ucaggcacggccgggccaccuu

SEQ ID NO: 3187 - RNA, 23 nt, Artificial Sequence
  Synthetic Construct
uauucauuuauccccagccuaca

SEQ ID NO: 3188 - RNA, 24 nt, Artificial Sequence
  Synthetic Construct
ugggcuaagggagaugauugggua

SEQ ID NO: 3189 - RNA, 20 nt, Artificial Sequence
  Synthetic Construct
gggccucagccuccugguuu

SEQ ID NO: 3190 - RNA, 19 nt, Artificial Sequence
  Synthetic Construct
ugcgccucgggugagcaug

SEQ ID NO: 3191 - RNA, 20 nt, Artificial Sequence
  Synthetic Construct
gucccugaguguauguggug

SEQ ID NO: 3192 - RNA, 23 nt, Artificial Sequence
  Synthetic Construct
aggaagcccuggaggggcuggag

SEQ ID NO: 3193 - RNA, 21 nt, Artificial Sequence
  Synthetic Construct
acaggcacgacugguuugguu

SEQ ID NO: 3194 - RNA, 21 nt, Artificial Sequence
  Synthetic Construct
acaggcacgacugguuuggca

SEQ ID NO: 3195 - RNA, 22 nt, Artificial Sequence
  Synthetic Construct
uccgaacucuccauuccucugc

SEQ ID NO: 3196 - RNA, 22 nt, Artificial Sequence
  Synthetic Construct
ucuacauccccacaucgccuuu

SEQ ID NO: 3197 - RNA, 21 nt, Artificial Sequence
  Synthetic Construct
auaagcccucugaccacuauu

SEQ ID NO: 3198 - RNA, 22 nt, Artificial Sequence
  Synthetic Construct
ggagaaucacugaugucagauu

SEQ ID NO: 3199 - RNA, 22 nt, Artificial Sequence
  Synthetic Construct
cgcgccugcaggaacugguaga

SEQ ID NO: 3200 - RNA, 23 nt, Artificial Sequence
  Synthetic Construct
ccuacaauaagccccugcccauu

SEQ ID NO: 3201 - RNA, 20 nt, Artificial Sequence
  Synthetic Construct
aggcgcacccgaccacaugc

SEQ ID NO: 3202 - RNA, 22 nt, Artificial Sequence
  Synthetic Construct
cccgacguuacucggacuauuu

SEQ ID NO: 3203 - RNA, 23 nt, Artificial Sequence
  Synthetic Construct
ccacgcccgccgcgggcccaguu

SEQ ID NO: 3204 - RNA, 20 nt, Artificial Sequence
  Synthetic Construct
cucgcccugucucccgcuag

SEQ ID NO: 3205 - RNA, 23 nt, Artificial Sequence
  Synthetic Construct
cucggggcaggcggcugggagcg

SEQ ID NO: 3206 - RNA, 23 nt, Artificial Sequence
  Synthetic Construct
uugggaugguaggaccagagggg

SEQ ID NO: 3207 - RNA, 22 nt, Artificial Sequence
  Synthetic Construct
ugggcgagggcggcugagcggc

SEQ ID NO: 3208 - RNA, 22 nt, Artificial Sequence
  Synthetic Construct
ccugacaccccaucugcccuca

SEQ ID NO: 3209 - RNA, 21 nt, Artificial Sequence
  Synthetic Construct
ucuauuccccacucuccccag

SEQ ID NO: 3210 - RNA, 23 nt, Artificial Sequence
  Synthetic Construct
uaacccuguccucucccucccag

SEQ ID NO: 3211 - RNA, 22 nt, Artificial Sequence
  Synthetic Construct
ugggaaagacaaacucagaguu

SEQ ID NO: 3212 - RNA, 23 nt, Artificial Sequence
  Synthetic Construct
uugaggggagaaugagguggaga

SEQ ID NO: 3213 - RNA, 25 nt, Artificial Sequence
  Synthetic Construct
cagggcagagggcacaggaaucuga

SEQ ID NO: 3214 - RNA, 21 nt, Artificial Sequence
  Synthetic Construct
cugggugagggcaucuguggu

SEQ ID NO: 3215 - RNA, 22 nt, Artificial Sequence
  Synthetic Construct
ucugugcuucaccccuacccag

SEQ ID NO: 3216 - RNA, 23 nt, Artificial Sequence
  Synthetic Construct
cgagggguagaagagcacagggg

SEQ ID NO: 3217 - RNA, 22 nt, Artificial Sequence
  Synthetic Construct
ugggaaagagaaagaacaagua

SEQ ID NO: 3218 - RNA, 22 nt, Artificial Sequence
  Synthetic Construct
aguuugggauggagagaggaga

SEQ ID NO: 3219 - RNA, 22 nt, Artificial Sequence
  Synthetic Construct
gugggugcuggugggagccgug

SEQ ID NO: 3220 - RNA, 20 nt, Artificial Sequence
  Synthetic Construct
accuggguuguccccucuag

SEQ ID NO: 3221 - RNA, 23 nt, Artificial Sequence
  Synthetic Construct
agccgcucuucucccugcccaca

SEQ ID NO: 3222 - RNA, 19 nt, Artificial Sequence
  Synthetic Construct
uggaugacaguggaggccu

SEQ ID NO: 3223 - RNA, 21 nt, Artificial Sequence
  Synthetic Construct
ccagaccuucuuccacccauu

SEQ ID NO: 3224 - RNA, 22 nt, Artificial Sequence
  Synthetic Construct
cagccgccgccugucuccacag

SEQ ID NO: 3225 - RNA, 24 nt, Artificial Sequence
  Synthetic Construct
agggguguggaaagaggcagaaca

SEQ ID NO: 3226 - RNA, 22 nt, Artificial Sequence
  Synthetic Construct
ugugggugggaaggacuggauu

SEQ ID NO: 3227 - RNA, 21 nt, Artificial Sequence
  Synthetic Construct
cuccuccccugccuggcccag

SEQ ID NO: 3228 - RNA, 20 nt, Artificial Sequence
  Synthetic Construct
cuguaugcccucaccgcuca

SEQ ID NO: 3229 - RNA, 21 nt, Artificial Sequence
  Synthetic Construct
gaacucacccucugcucccag

SEQ ID NO: 3230 - RNA, 21 nt, Artificial Sequence
  Synthetic Construct
acugagccucucucucuccag

SEQ ID NO: 3231 - RNA, 22 nt, Artificial Sequence
  Synthetic Construct
gggggguguggagccagggggc

SEQ ID NO: 3232 - RNA, 22 nt, Artificial Sequence
  Synthetic Construct
caccagggcagagcagggcuga

SEQ ID NO: 3233 - RNA, 22 nt, Artificial Sequence
  Synthetic Construct
ccagggaggcugguuuggagga

SEQ ID NO: 3234 - RNA, 22 nt, Artificial Sequence
  Synthetic Construct
uaggguagacacugacaacguu

SEQ ID NO: 3235 - RNA, 23 nt, Artificial Sequence
  Synthetic Construct
aggguggggcuggagguggggcu

SEQ ID NO: 3236 - RNA, 22 nt, Artificial Sequence
  Synthetic Construct
aacacuggccuugcuaucccca

SEQ ID NO: 3237 - RNA, 23 nt, Artificial Sequence
  Synthetic Construct
uagagaggggaaggaugugaugu

SEQ ID NO: 3238 - RNA, 22 nt, Artificial Sequence
  Synthetic Construct
ugaccuuugccucuccccucag

SEQ ID NO: 3239 - RNA, 21 nt, Artificial Sequence
  Synthetic Construct
ucuucaaccucaggacuugca

SEQ ID NO: 3240 - RNA, 21 nt, Artificial Sequence
  Synthetic Construct
acacuguccccuucuccccag

SEQ ID NO: 3241 - RNA, 22 nt, Artificial Sequence
  Synthetic Construct
uccuacgcugcucucucacucc

SEQ ID NO: 3242 - RNA, 23 nt, Artificial Sequence
  Synthetic Construct
uggcugcuucccuuggucuccag

SEQ ID NO: 3243 - RNA, 21 nt, Artificial Sequence
  Synthetic Construct
cuccccggccucugcccccag

SEQ ID NO: 3244 - RNA, 22 nt, Artificial Sequence
  Synthetic Construct
ucccagggucuggucagaguug

SEQ ID NO: 3245 - RNA, 25 nt, Artificial Sequence
  Synthetic Construct
gugaggcggggccaggagggugugu

SEQ ID NO: 3246 - RNA, 22 nt, Artificial Sequence
  Synthetic Construct
ugauugucuucccccacccuca

SEQ ID NO: 3247 - RNA, 22 nt, Artificial Sequence
  Synthetic Construct
ccacgugcuucucuuuccgcag

SEQ ID NO: 3248 - RNA, 23 nt, Artificial Sequence
  Synthetic Construct
cacacaggaaaagcggggcccug

SEQ ID NO: 3249 - RNA, 21 nt, Artificial Sequence
  Synthetic Construct
agguggguauggaggagcccu

SEQ ID NO: 3250 - RNA, 21 nt, Artificial Sequence
  Synthetic Construct
cccucucugucccacccauag

SEQ ID NO: 3251 - RNA, 21 nt, Artificial Sequence
  Synthetic Construct
cuggcggcugugucuucacag

SEQ ID NO: 3252 - RNA, 21 nt, Artificial Sequence
  Synthetic Construct
caaaccccugucuacccgcag

SEQ ID NO: 3253 - RNA, 23 nt, Artificial Sequence
  Synthetic Construct
uugcuccugacucugugcccaca

SEQ ID NO: 3254 - RNA, 23 nt, Artificial Sequence
  Synthetic Construct
uugggcccaggaguaaacaggau

SEQ ID NO: 3255 - RNA, 21 nt, Artificial Sequence
  Synthetic Construct
ucgugucccucuuguccacag

SEQ ID NO: 3256 - RNA, 25 nt, Artificial Sequence
  Synthetic Construct
ucggggcaugggggagggaggcugg

SEQ ID NO: 3257 - RNA, 23 nt, Artificial Sequence
  Synthetic Construct
caaccaccacugucucuccccag

SEQ ID NO: 3258 - RNA, 23 nt, Artificial Sequence
  Synthetic Construct
acggggagucaggcaguggugga

SEQ ID NO: 3259 - RNA, 22 nt, Artificial Sequence
  Synthetic Construct
agugggaggacaggaggcaggu

SEQ ID NO: 3260 - RNA, 21 nt, Artificial Sequence
  Synthetic Construct
cugggaggggcuggguuuggc

SEQ ID NO: 3261 - RNA, 23 nt, Artificial Sequence
  Synthetic Construct
uugggagggaagacagcuggaga

SEQ ID NO: 3262 - RNA, 23 nt, Artificial Sequence
  Synthetic Construct
uggggaaggcuuggcagggaaga

SEQ ID NO: 3263 - RNA, 22 nt, Artificial Sequence
  Synthetic Construct
ugccucuuuuccacggccucag

SEQ ID NO: 3264 - RNA, 23 nt, Artificial Sequence
  Synthetic Construct
caccuuuguguccccauccugca

SEQ ID NO: 3265 - RNA, 22 nt, Artificial Sequence
  Synthetic Construct
uaggggaaaaguccugauccgg

SEQ ID NO: 3266 - RNA, 20 nt, Artificial Sequence
  Synthetic Construct
gccggggcuuugggugaggg

SEQ ID NO: 3267 - RNA, 22 nt, Artificial Sequence
  Synthetic Construct
ugggagggcguggaugauggug

SEQ ID NO: 3268 - RNA, 21 nt, Artificial Sequence
  Synthetic Construct
gcgguggggccggaggggcgu

SEQ ID NO: 3269 - RNA, 22 nt, Artificial Sequence
  Synthetic Construct
uggcggggguagagcuggcugc

SEQ ID NO: 3270 - RNA, 22 nt, Artificial Sequence
  Synthetic Construct
uucgccacuucccucccugcag

SEQ ID NO: 3271 - RNA, 24 nt, Artificial Sequence
  Synthetic Construct
guaggggcgucccgggcgcgcggg

SEQ ID NO: 3272 - RNA, 21 nt, Artificial Sequence
  Synthetic Construct
cgaccucggcgaccccucacu

SEQ ID NO: 3273 - RNA, 21 nt, Artificial Sequence
  Synthetic Construct
ugccuccuuggucuccggcag

SEQ ID NO: 3274 - RNA, 21 nt, Artificial Sequence
  Synthetic Construct
guaagcaggggcucuggguga

SEQ ID NO: 3275 - RNA, 20 nt, Artificial Sequence
  Synthetic Construct
uccccaaccccugcccgcag

SEQ ID NO: 3276 - RNA, 20 nt, Artificial Sequence
  Synthetic Construct
cucacucucagucccucccu

SEQ ID NO: 3277 - RNA, 21 nt, Artificial Sequence
  Synthetic Construct
accccucguuucuucccccag

SEQ ID NO: 3278 - RNA, 23 nt, Artificial Sequence
  Synthetic Construct
uugugggguuggagagcuggcug

SEQ ID NO: 3279 - RNA, 25 nt, Artificial Sequence
  Synthetic Construct
aggagggaaggggcugagaacagga

SEQ ID NO: 3280 - RNA, 21 nt, Artificial Sequence
  Synthetic Construct
cuaccccccaucccccuguag

SEQ ID NO: 3281 - RNA, 23 nt, Artificial Sequence
  Synthetic Construct
ugcccugcaugguguccccacag

SEQ ID NO: 3282 - RNA, 21 nt, Artificial Sequence
  Synthetic Construct
caccucuccuggcaucgcccc

SEQ ID NO: 3283 - RNA, 20 nt, Artificial Sequence
  Synthetic Construct
accccugccacucacuggcc

SEQ ID NO: 3284 - RNA, 20 nt, Artificial Sequence
  Synthetic Construct
cuagguggggggcuugaagc

SEQ ID NO: 3285 - RNA, 22 nt, Artificial Sequence
  Synthetic Construct
cuggggguggggggcugggcgu

SEQ ID NO: 3286 - RNA, 22 nt, Artificial Sequence
  Synthetic Construct
cgcaccugccucucacccacag

SEQ ID NO: 3287 - RNA, 22 nt, Artificial Sequence
  Synthetic Construct
uagggggcggcuuguggagugu

SEQ ID NO: 3288 - RNA, 24 nt, Artificial Sequence
  Synthetic Construct
uguaggcaugaggcagggcccagg

SEQ ID NO: 3289 - RNA, 23 nt, Artificial Sequence
  Synthetic Construct
cacugcauuccugcuuggcccag

SEQ ID NO: 3290 - RNA, 21 nt, Artificial Sequence
  Synthetic Construct
gugugaccaccguuccugcag

SEQ ID NO: 3291 - RNA, 22 nt, Artificial Sequence
  Synthetic Construct
uggcaaggaaagaagaggauca

SEQ ID NO: 3292 - RNA, 23 nt, Artificial Sequence
  Synthetic Construct
uccccugcucccuuguuccccag

SEQ ID NO: 3293 - RNA, 22 nt, Artificial Sequence
  Synthetic Construct
augcaggccuguguacagcacu

SEQ ID NO: 3294 - RNA, 21 nt, Artificial Sequence
  Synthetic Construct
ccgcucuuccccugaccccag

SEQ ID NO: 3295 - RNA, 21 nt, Artificial Sequence
  Synthetic Construct
aaccuuggccccucuccccag

SEQ ID NO: 3296 - RNA, 22 nt, Artificial Sequence
  Synthetic Construct
ucccaagggugagaugcugcca

SEQ ID NO: 3297 - RNA, 21 nt, Artificial Sequence
  Synthetic Construct
uggcuucucuugcacacccag

SEQ ID NO: 3298 - RNA, 18 nt, Artificial Sequence
  Synthetic Construct
gaaggaccugcaccuucg

SEQ ID NO: 3299 - RNA, 19 nt, Artificial Sequence
  Synthetic Construct
ucucucugacuccauggca

SEQ ID NO: 3300 - RNA, 22 nt, Artificial Sequence
  Synthetic Construct
uugucucuuguuccucacacag

SEQ ID NO: 3301 - RNA, 21 nt, Artificial Sequence
  Synthetic Construct
aagccucuguccccaccccag

SEQ ID NO: 3302 - RNA, 22 nt, Artificial Sequence
  Synthetic Construct
ugugacuucuccccugccacag

SEQ ID NO: 3303 - RNA, 21 nt, Artificial Sequence
  Synthetic Construct
ugaccucuccgcuccgcacag

SEQ ID NO: 3304 - RNA, 20 nt, Artificial Sequence
  Synthetic Construct
cagggaaccaguuggggcuu

SEQ ID NO: 3305 - RNA, 21 nt, Artificial Sequence
  Synthetic Construct
ugagccucuccuucccuccag

SEQ ID NO: 3306 - RNA, 21 nt, Artificial Sequence
  Synthetic Construct
ucucuggucuugccaccccag

SEQ ID NO: 3307 - RNA, 22 nt, Artificial Sequence
  Synthetic Construct
uggggagguguggagucagcau

SEQ ID NO: 3308 - RNA, 23 nt, Artificial Sequence
  Synthetic Construct
ucaauaggaaagaggugggaccu

SEQ ID NO: 3309 - RNA, 21 nt, Artificial Sequence
  Synthetic Construct
accgucucuucuguuccccag

SEQ ID NO: 3310 - RNA, 22 nt, Artificial Sequence
  Synthetic Construct
aggaagcaagagaacccugugg

SEQ ID NO: 3311 - RNA, 20 nt, Artificial Sequence
  Synthetic Construct
ugccuccuccguggccucag

SEQ ID NO: 3312 - RNA, 23 nt, Artificial Sequence
  Synthetic Construct
ugucuuucuucucucccuugcag

SEQ ID NO: 3313 - RNA, 21 nt, Artificial Sequence
  Synthetic Construct
ugacuaacucccacucuacag

SEQ ID NO: 3314 - RNA, 20 nt, Artificial Sequence
  Synthetic Construct
acccuuuuucucuuucccag

SEQ ID NO: 3315 - RNA, 22 nt, Artificial Sequence
  Synthetic Construct
guguggaagaugggaggagaaa

SEQ ID NO: 3316 - RNA, 20 nt, Artificial Sequence
  Synthetic Construct
uaugucccaucccuccauca

SEQ ID NO: 3317 - RNA, 23 nt, Artificial Sequence
  Synthetic Construct
aaaagcacuuuucugucucccag

SEQ ID NO: 3318 - RNA, 22 nt, Artificial Sequence
  Synthetic Construct
cgcagggcccuggcgcaggcau

SEQ ID NO: 3319 - RNA, 23 nt, Artificial Sequence
  Synthetic Construct
ccuucacugugacucugcugcag

SEQ ID NO: 3320 - RNA, 20 nt, Artificial Sequence
  Synthetic Construct
aaguccugcuucuguugcag

SEQ ID NO: 3321 - RNA, 22 nt, Artificial Sequence
  Synthetic Construct
uuggguuuucucuucaauccag

SEQ ID NO: 3322 - RNA, 22 nt, Artificial Sequence
  Synthetic Construct
gcccaggacuuugugcggggug

SEQ ID NO: 3323 - RNA, 21 nt, Artificial Sequence
  Synthetic Construct
accuugcaucugcauccccag

SEQ ID NO: 3324 - RNA, 22 nt, Artificial Sequence
  Synthetic Construct
uuggcuggucucugcuccgcag

SEQ ID NO: 3325 - RNA, 21 nt, Artificial Sequence
  Synthetic Construct
gcagagaacaggagaccauuu

SEQ ID NO: 3326 - RNA, 21 nt, Artificial Sequence
  Synthetic Construct
gugaauuaaaaacaaagaauu

SEQ ID NO: 3327 - RNA, 21 nt, Artificial Sequence
  Synthetic Construct
ccucuccucccugugccccag

SEQ ID NO: 3328 - RNA, 22 nt, Artificial Sequence
  Synthetic Construct
ugggggcuggaugggguagagu

SEQ ID NO: 3329 - RNA, 23 nt, Artificial Sequence
  Synthetic Construct
acagaggacaguggagugugagc

SEQ ID NO: 3330 - RNA, 19 nt, Artificial Sequence
  Synthetic Construct
guggucucuuggcccccag

SEQ ID NO: 3331 - RNA, 23 nt, Artificial Sequence
  Synthetic Construct
gaguggauaggggagugugugga

SEQ ID NO: 3332 - RNA, 22 nt, Artificial Sequence
  Synthetic Construct
gugcggaacgcuggccggggcg

SEQ ID NO: 3333 - RNA, 21 nt, Artificial Sequence
  Synthetic Construct
uggcccuuuguaccccuccag

SEQ ID NO: 3334 - RNA, 17 nt, Artificial Sequence
  Synthetic Construct
uguccucuguuccucag

SEQ ID NO: 3335 - RNA, 22 nt, Artificial Sequence
  Synthetic Construct
uguucauuggaacccugcgcag

SEQ ID NO: 3336 - RNA, 24 nt, Artificial Sequence
  Synthetic Construct
aagcucagguuugagaacugcuga

SEQ ID NO: 3337 - RNA, 25 nt, Artificial Sequence
  Synthetic Construct
uugggguuuggggugcagacauugc

SEQ ID NO: 3338 - RNA, 24 nt, Artificial Sequence
  Synthetic Construct
aagagaggagcaguggugcugugg

SEQ ID NO: 3339 - RNA, 22 nt, Artificial Sequence
  Synthetic Construct
uuggggauugggucaggccagu

SEQ ID NO: 3340 - RNA, 22 nt, Artificial Sequence
  Synthetic Construct
gugaggaggggcuggcagggac

SEQ ID NO: 3341 - RNA, 23 nt, Artificial Sequence
  Synthetic Construct
gagaggaacaugggcucaggaca

SEQ ID NO: 3342 - RNA, 22 nt, Artificial Sequence
  Synthetic Construct
ucaccacagcccugcccaguuu

SEQ ID NO: 3343 - RNA, 18 nt, Artificial Sequence
  Synthetic Construct
uggaccucuccuccccag

SEQ ID NO: 3344 - RNA, 22 nt, Artificial Sequence
  Synthetic Construct
cgggcaugcugggagagacuuu

SEQ ID NO: 3345 - RNA, 23 nt, Artificial Sequence
  Synthetic Construct
cucaauccuucaccacgucuauu

SEQ ID NO: 3346 - RNA, 21 nt, Artificial Sequence
  Synthetic Construct
gugagacuucucucccuucag

SEQ ID NO: 3347 - RNA, 23 nt, Artificial Sequence
  Synthetic Construct
uagguggcagaggagggacuuca

SEQ ID NO: 3348 - RNA, 23 nt, Artificial Sequence
  Synthetic Construct
uuagaggcuggaauagagauucu

SEQ ID NO: 3349 - RNA, 21 nt, Artificial Sequence
  Synthetic Construct
cucucccucuuuacccacuag

SEQ ID NO: 3350 - RNA, 21 nt, Artificial Sequence
  Synthetic Construct
uuccuucuguugucugugcag

SEQ ID NO: 3351 - RNA, 21 nt, Artificial Sequence
  Synthetic Construct
cgccgcgcgcaucggcucagc

SEQ ID NO: 3352 - RNA, 22 nt, Artificial Sequence
  Synthetic Construct
gcucauccccaucuccuuucag

SEQ ID NO: 3353 - RNA, 22 nt, Artificial Sequence
  Synthetic Construct
cagcacccuguggcucccacag

SEQ ID NO: 3354 - RNA, 20 nt, Artificial Sequence
  Synthetic Construct
ucucgcaucaggaggcaagg

SEQ ID NO: 3355 - RNA, 22 nt, Artificial Sequence
  Synthetic Construct
cagagggaauacagagggcaau

SEQ ID NO: 3356 - RNA, 23 nt, Artificial Sequence
  Synthetic Construct
caguucugcuguucugacucuag

SEQ ID NO: 3357 - RNA, 22 nt, Artificial Sequence
  Synthetic Construct
auucuuccugcccuggcuccau

SEQ ID NO: 3358 - RNA, 22 nt, Artificial Sequence
  Synthetic Construct
caggaaggagacaggcaguuca

SEQ ID NO: 3359 - RNA, 22 nt, Artificial Sequence
  Synthetic Construct
agggccgaaggguggaagcugc

SEQ ID NO: 3360 - RNA, 23 nt, Artificial Sequence
  Synthetic Construct
agggagaaagcuagaagcugaag

SEQ ID NO: 3361 - RNA, 22 nt, Artificial Sequence
  Synthetic Construct
cagggcagggaaggugggagag

SEQ ID NO: 3362 - RNA, 21 nt, Artificial Sequence
  Synthetic Construct
ccgccuucucuccucccccag

SEQ ID NO: 3363 - RNA, 22 nt, Artificial Sequence
  Synthetic Construct
ugggguaaggauaggaggguca

SEQ ID NO: 3364 - RNA, 22 nt, Artificial Sequence
  Synthetic Construct
uacaagucaggagcugaagcag

SEQ ID NO: 3365 - RNA, 22 nt, Artificial Sequence
  Synthetic Construct
agggagggugugguauggaugu

SEQ ID NO: 3366 - RNA, 22 nt, Artificial Sequence
  Synthetic Construct
agaggcugagaaggugauguug

SEQ ID NO: 3367 - RNA, 21 nt, Artificial Sequence
  Synthetic Construct
cuuugcuuccugcuccccuag

SEQ ID NO: 3368 - RNA, 21 nt, Artificial Sequence
  Synthetic Construct
cccgcaggugagaugagggcu

SEQ ID NO: 3369 - RNA, 23 nt, Artificial Sequence
  Synthetic Construct
uggggggacagauggagaggaca

SEQ ID NO: 3370 - RNA, 21 nt, Artificial Sequence
  Synthetic Construct
aucugucucgauuguuuccag

SEQ ID NO: 3371 - RNA, 20 nt, Artificial Sequence
  Synthetic Construct
ucugugccccuacuucccag

SEQ ID NO: 3372 - RNA, 21 nt, Artificial Sequence
  Synthetic Construct
caugggguagggcagaguagg

SEQ ID NO: 3373 - RNA, 19 nt, Artificial Sequence
  Synthetic Construct
uaaggagggggaugagggg

SEQ ID NO: 3374 - RNA, 21 nt, Artificial Sequence
  Synthetic Construct
ucccucucccaccccuugcag

SEQ ID NO: 3375 - RNA, 21 nt, Artificial Sequence
  Synthetic Construct
caggcagguguaggguggagc

SEQ ID NO: 3376 - RNA, 24 nt, Artificial Sequence
  Synthetic Construct
aggaggauggagagcugggccaga

SEQ ID NO: 3377 - RNA, 22 nt, Artificial Sequence
  Synthetic Construct
ugucucucgcccuuggccuuag

SEQ ID NO: 3378 - RNA, 22 nt, Artificial Sequence
  Synthetic Construct
caacaaaucacagucugccaua

SEQ ID NO: 3379 - RNA, 22 nt, Artificial Sequence
  Synthetic Construct
caacaaaucccagucuaccuaa

SEQ ID NO: 3380 - RNA, 23 nt, Artificial Sequence
  Synthetic Construct
aaggagcuuacaaucuagcuggg

SEQ ID NO: 3381 - RNA, 23 nt, Artificial Sequence
  Synthetic Construct
agcucccugaaucccugucccag

SEQ ID NO: 3382 - RNA, 27 nt, Artificial Sequence
  Synthetic Construct
uggucuguucauucucucuuuuuggcc

SEQ ID NO: 3383 - RNA, 20 nt, Artificial Sequence
  Synthetic Construct
acccgcccgucuccccacag

SEQ ID NO: 3384 - RNA, 21 nt, Artificial Sequence
  Synthetic Construct
cuggggggaggagacccugcu

SEQ ID NO: 3385 - RNA, 22 nt, Artificial Sequence
  Synthetic Construct
uacgucucucccugggucccuu

SEQ ID NO: 3386 - RNA, 21 nt, Artificial Sequence
  Synthetic Construct
uggggguguggggagagagag

SEQ ID NO: 3387 - RNA, 22 nt, Artificial Sequence
  Synthetic Construct
ugggggaggaaggacaggccau

SEQ ID NO: 3388 - RNA, 22 nt, Artificial Sequence
  Synthetic Construct
acgggcagggcagugcacccug

SEQ ID NO: 3389 - RNA, 23 nt, Artificial Sequence
  Synthetic Construct
ccucccugcccgccucucugcag

SEQ ID NO: 3390 - RNA, 21 nt, Artificial Sequence
  Synthetic Construct
ucuguggaguggggugccugu

SEQ ID NO: 3391 - RNA, 18 nt, Artificial Sequence
  Synthetic Construct
ccucucccccugccaguu

SEQ ID NO: 3392 - RNA, 21 nt, Artificial Sequence
  Synthetic Construct
cuacaggcuggaaugggcuca

SEQ ID NO: 3393 - RNA, 22 nt, Artificial Sequence
  Synthetic Construct
uuuccuguccuccaaccagacc

SEQ ID NO: 3394 - RNA, 23 nt, Artificial Sequence
  Synthetic Construct
ugagaacugacaaaugugguagg

SEQ ID NO: 3395 - RNA, 20 nt, Artificial Sequence
  Synthetic Construct
aggaggacaaguugugggau

SEQ ID NO: 3396 - RNA, 19 nt, Artificial Sequence
  Synthetic Construct
ucuggggucuugggccauc

SEQ ID NO: 3397 - RNA, 23 nt, Artificial Sequence
  Synthetic Construct
uuguucucaaacuggcugucaga

SEQ ID NO: 3398 - RNA, 23 nt, Artificial Sequence
  Synthetic Construct
ucagcauucauuggcaccagaga

SEQ ID NO: 3399 - RNA, 21 nt, Artificial Sequence
  Synthetic Construct
cugaacuagagauugggccca

SEQ ID NO: 3400 - RNA, 21 nt, Artificial Sequence
  Synthetic Construct
uucaacaaggguguaggaugg

SEQ ID NO: 3401 - RNA, 21 nt, Artificial Sequence
  Synthetic Construct
ugcugagguccgggcugugcc

SEQ ID NO: 3402 - RNA, 28 nt, Artificial Sequence
  Synthetic Construct
uagaucuuugacucuggcagucuccagg

SEQ ID NO: 3403 - RNA, 18 nt, Artificial Sequence
  Synthetic Construct
ugcuuccuuucucagcug

SEQ ID NO: 3404 - RNA, 21 nt, Artificial Sequence
  Synthetic Construct
acgcccggcggggcggaaguu

SEQ ID NO: 3405 - RNA, 22 nt, Artificial Sequence
  Synthetic Construct
cuguugccacuaaccucaaccu

SEQ ID NO: 3406 - RNA, 18 nt, Artificial Sequence
  Synthetic Construct
caccaucuucccuucuuu

SEQ ID NO: 3407 - RNA, 22 nt, Artificial Sequence
  Synthetic Construct
gaugguugaccagagagcacac

SEQ ID NO: 3408 - RNA, 22 nt, Artificial Sequence
  Synthetic Construct
caaaauuguuugcacucugcuu

SEQ ID NO: 3409 - RNA, 20 nt, Artificial Sequence
  Synthetic Construct
cccacagacccagagccguu

SEQ ID NO: 3410 - RNA, 22 nt, Artificial Sequence
  Synthetic Construct
ugucaguuucacccugcugcuu

SEQ ID NO: 3411 - RNA, 22 nt, Artificial Sequence
  Synthetic Construct
ucggccccggccccagccccuu

SEQ ID NO: 3412 - RNA, 22 nt, Artificial Sequence
  Synthetic Construct
gaggacaagugagcaccugcuu

SEQ ID NO: 3413 - RNA, 19 nt, Artificial Sequence
  Synthetic Construct
uuagcuuccgagaucaauu

SEQ ID NO: 3414 - RNA, 21 nt, Artificial Sequence
  Synthetic Construct
ucaccuuccuucuccuccauu

SEQ ID NO: 3415 - RNA, 22 nt, Artificial Sequence
  Synthetic Construct
acuccagccccacagccucagc

SEQ ID NO: 3416 - RNA, 23 nt, Artificial Sequence
  Synthetic Construct
ucugcucauaccccaugguuucu

SEQ ID NO: 3417 - RNA, 22 nt, Artificial Sequence
  Synthetic Construct
ugagaccucuggguucugagcu

SEQ ID NO: 3418 - RNA, 23 nt, Artificial Sequence
  Synthetic Construct
gcccugacacgugguacuggauu

SEQ ID NO: 3419 - RNA, 22 nt, Artificial Sequence
  Synthetic Construct
agggagucuggcagucuaaguu

SEQ ID NO: 3420 - RNA, 23 nt, Artificial Sequence
  Synthetic Construct
ugggagaaggccagagugcaauu

SEQ ID NO: 3421 - RNA, 19 nt, Artificial Sequence
  Synthetic Construct
cgucgccgccgaccccguu

SEQ ID NO: 3422 - RNA, 23 nt, Artificial Sequence
  Synthetic Construct
gaacugacauucugagcuauuuu

SEQ ID NO: 3423 - RNA, 24 nt, Artificial Sequence
  Synthetic Construct
ucggcagagcacaggcgcuucauu

SEQ ID NO: 3424 - RNA, 22 nt, Artificial Sequence
  Synthetic Construct
gagggcagagccagcuuccuga

SEQ ID NO: 3425 - RNA, 22 nt, Artificial Sequence
  Synthetic Construct
caccacacaguccuaguuuuuu

SEQ ID NO: 3426 - RNA, 21 nt, Artificial Sequence
  Synthetic Construct
acgacccucccugucccuuuu

SEQ ID NO: 3427 - RNA, 21 nt, Artificial Sequence
  Synthetic Construct
uucucuccaggcuccgcuguu

SEQ ID NO: 3428 - RNA, 21 nt, Artificial Sequence
  Synthetic Construct
cuccuccucguccuccacguu

SEQ ID NO: 3429 - RNA, 23 nt, Artificial Sequence
  Synthetic Construct
ugguaagcagaccgaggguaguu

SEQ ID NO: 3430 - RNA, 22 nt, Artificial Sequence
  Synthetic Construct
gcccaagaucaacaauugucuu

SEQ ID NO: 3431 - RNA, 21 nt, Artificial Sequence
  Synthetic Construct
agccacacuauguccaaacuu

SEQ ID NO: 3432 - RNA, 22 nt, Artificial Sequence
  Synthetic Construct
caaccucagucucccagguauu

SEQ ID NO: 3433 - RNA, 22 nt, Artificial Sequence
  Synthetic Construct
augccuuugacuacuacauauu

SEQ ID NO: 3434 - RNA, 21 nt, Artificial Sequence
  Synthetic Construct
agucaggaucugcauuugauu

SEQ ID NO: 3435 - RNA, 21 nt, Artificial Sequence
  Synthetic Construct
cccaucugcggucaccucauu

SEQ ID NO: 3436 - RNA, 22 nt, Artificial Sequence
  Synthetic Construct
gagcuugggguccucaccaauu

SEQ ID NO: 3437 - RNA, 21 nt, Artificial Sequence
  Synthetic Construct
ucccucaguguccuuaaaauu

SEQ ID NO: 3438 - RNA, 20 nt, Artificial Sequence
  Synthetic Construct
aauuauucuagggucacauu

SEQ ID NO: 3439 - RNA, 24 nt, Artificial Sequence
  Synthetic Construct
gcucaggagagcaucacagccuuu

SEQ ID NO: 3440 - RNA, 18 nt, Artificial Sequence
  Synthetic Construct
gugccgugacuaggauuu

SEQ ID NO: 3441 - RNA, 19 nt, Artificial Sequence
  Synthetic Construct
gcaaaagucucagggcauu

SEQ ID NO: 3442 - RNA, 18 nt, Artificial Sequence
  Synthetic Construct
gugcguuggcugggaauu

SEQ ID NO: 3443 - RNA, 21 nt, Artificial Sequence
  Synthetic Construct
agcaacgcuauacaccagauu

SEQ ID NO: 3444 - RNA, 23 nt, Artificial Sequence
  Synthetic Construct
aaggaugaaucuuuguuacuguu

SEQ ID NO: 3445 - RNA, 22 nt, Artificial Sequence
  Synthetic Construct
ucaugcccucuacagucccguu

SEQ ID NO: 3446 - RNA, 24 nt, Artificial Sequence
  Synthetic Construct
ccauugaguuccaaaaucgccauu

SEQ ID NO: 3447 - RNA, 21 nt, Artificial Sequence
  Synthetic Construct
ccauccgaucuguacuuucuu

SEQ ID NO: 3448 - RNA, 23 nt, Artificial Sequence
  Synthetic Construct
cgucugcucaugugcucaaaguu

SEQ ID NO: 3449 - RNA, 20 nt, Artificial Sequence
  Synthetic Construct
gcauccagacaauccacguu

SEQ ID NO: 3450 - RNA, 21 nt, Artificial Sequence
  Synthetic Construct
caucuuacuacagagccacuu

SEQ ID NO: 3451 - RNA, 22 nt, Artificial Sequence
  Synthetic Construct
auggcaagaucaaaguccaguu

SEQ ID NO: 3452 - RNA, 22 nt, Artificial Sequence
  Synthetic Construct
cuuuucaucuacaguuccccuu

SEQ ID NO: 3453 - RNA, 24 nt, Artificial Sequence
  Synthetic Construct
ccuccuacccacugcuucaugguu

SEQ ID NO: 3454 - RNA, 21 nt, Artificial Sequence
  Synthetic Construct
caauauccucuaaucuaaguu

SEQ ID NO: 3455 - RNA, 21 nt, Artificial Sequence
  Synthetic Construct
aauaauccucaaaucacuguu

SEQ ID NO: 3456 - RNA, 22 nt, Artificial Sequence
  Synthetic Construct
gccccgacuccugauuuugauu

SEQ ID NO: 3457 - RNA, 20 nt, Artificial Sequence
  Synthetic Construct
ccgcucgcucagugugcuuu

SEQ ID NO: 3458 - RNA, 24 nt, Artificial Sequence
  Synthetic Construct
ccaaaauucaacuguuccuacauu

SEQ ID NO: 3459 - RNA, 21 nt, Artificial Sequence
  Synthetic Construct
cauccaaaagaucacauuguu

SEQ ID NO: 3460 - RNA, 22 nt, Artificial Sequence
  Synthetic Construct
cuaaguuuacaguuucuagguu

SEQ ID NO: 3461 - RNA, 22 nt, Artificial Sequence
  Synthetic Construct
aacgauccuuacaacaaacauu

SEQ ID NO: 3462 - RNA, 23 nt, Artificial Sequence
  Synthetic Construct
gccgaccgcccccaaccauccuu

SEQ ID NO: 3463 - RNA, 22 nt, Artificial Sequence
  Synthetic Construct
gagucagccgucaaucacauuu

SEQ ID NO: 3464 - RNA, 20 nt, Artificial Sequence
  Synthetic Construct
acccacuccaguccaccguu

SEQ ID NO: 3465 - RNA, 20 nt, Artificial Sequence
  Synthetic Construct
gccuaccuccccgccgccuu

SEQ ID NO: 3466 - RNA, 22 nt, Artificial Sequence
  Synthetic Construct
gacgcucccugcugccagguuu

SEQ ID NO: 3467 - RNA, 24 nt, Artificial Sequence
  Synthetic Construct
guacaugccagucucgccauaguu

SEQ ID NO: 3468 - RNA, 24 nt, Artificial Sequence
  Synthetic Construct
gacccgacaucugccaucagcauu

SEQ ID NO: 3469 - RNA, 24 nt, Artificial Sequence
  Synthetic Construct
uuguaucagaaaaguccauauauu

SEQ ID NO: 3470 - RNA, 22 nt, Artificial Sequence
  Synthetic Construct
agucagaaccccacucagccuu

SEQ ID NO: 3471 - RNA, 23 nt, Artificial Sequence
  Synthetic Construct
gucucucaccgggccuagaccuu

SEQ ID NO: 3472 - RNA, 20 nt, Artificial Sequence
  Synthetic Construct
cagcagagacgaucacuguu

SEQ ID NO: 3473 - RNA, 23 nt, Artificial Sequence
  Synthetic Construct
ccguugacaccaguguccuucuu

SEQ ID NO: 3474 - RNA, 23 nt, Artificial Sequence
  Synthetic Construct
uucagaaaggcacgacucaaguu

SEQ ID NO: 3475 - RNA, 22 nt, Artificial Sequence
  Synthetic Construct
gaguauucccagcuccaucauu

SEQ ID NO: 3476 - RNA, 21 nt, Artificial Sequence
  Synthetic Construct
uugcagccgucaaguccuguu

SEQ ID NO: 3477 - RNA, 23 nt, Artificial Sequence
  Synthetic Construct
cugauuuuuuacuuaguauucuu

SEQ ID NO: 3478 - RNA, 21 nt, Artificial Sequence
  Synthetic Construct
cucacaguccucucucccauu

SEQ ID NO: 3479 - RNA, 22 nt, Artificial Sequence
  Synthetic Construct
cauaucaguccagacuagcauu

SEQ ID NO: 3480 - RNA, 23 nt, Artificial Sequence
  Synthetic Construct
ccuguaauccaagaagucuucuu

SEQ ID NO: 3481 - RNA, 21 nt, Artificial Sequence
  Synthetic Construct
ccccuuuccaguaccgagguu

SEQ ID NO: 3482 - RNA, 24 nt, Artificial Sequence
  Synthetic Construct
gccccaauccccuguccccagguu

SEQ ID NO: 3483 - RNA, 21 nt, Artificial Sequence
  Synthetic Construct
acguguguguguguguguguu

SEQ ID NO: 3484 - RNA, 22 nt, Artificial Sequence
  Synthetic Construct
ggagacugaugaguucccggga

SEQ ID NO: 3485 - RNA, 22 nt, Artificial Sequence
  Synthetic Construct
cugcccuggcccgagggaccga

SEQ ID NO: 3486 - RNA, 21 nt, Artificial Sequence
  Synthetic Construct
ccuggaaacacugagguugug

SEQ ID NO: 3487 - RNA, 22 nt, Artificial Sequence
  Synthetic Construct
uggugguuuacaaaguaauuca

SEQ ID NO: 3488 - RNA, 20 nt, Artificial Sequence
  Synthetic Construct
guagaggagauggcgcaggg

SEQ ID NO: 3489 - RNA, 22 nt, Artificial Sequence
  Synthetic Construct
aggcagcgggguguaguggaua

SEQ ID NO: 3490 - RNA, 22 nt, Artificial Sequence
  Synthetic Construct
gugaacgggcgccaucccgagg

SEQ ID NO: 3491 - RNA, 22 nt, Artificial Sequence
  Synthetic Construct
gacugacaccucuuugggugaa

SEQ ID NO: 3492 - RNA, 21 nt, Artificial Sequence
  Synthetic Construct
uuaauaucggacaaccauugu

SEQ ID NO: 3493 - RNA, 21 nt, Artificial Sequence
  Synthetic Construct
acugaugccuuuccaaguauu

SEQ ID NO: 3494 - RNA, 22 nt, Artificial Sequence
  Synthetic Construct
ugcaacgaaccugagccacuga

SEQ ID NO: 3495 - RNA, 22 nt, Artificial Sequence
  Synthetic Construct
aaugacucagguaaguugcauu

SEQ ID NO: 3496 - RNA, 21 nt, Artificial Sequence
  Synthetic Construct
acgcagaaaggacacaguguu

SEQ ID NO: 3497 - RNA, 22 nt, Artificial Sequence
  Synthetic Construct
uacccagaaaggagccaguguu

SEQ ID NO: 3498 - RNA, 21 nt, Artificial Sequence
  Synthetic Construct
uauucagaaaggugccaguca

SEQ ID NO: 3499 - RNA, 22 nt, Artificial Sequence
  Synthetic Construct
auaaagcuagauaaccgaaagu

SEQ ID NO: 3500 - RNA, 20 nt, Artificial Sequence
  Synthetic Construct
cugcuuccacagcuccccuu

SEQ ID NO: 3501 - RNA, 25 nt, Artificial Sequence
  Synthetic Construct
auccugguucugucccucacuaguu

SEQ ID NO: 3502 - RNA, 23 nt, Artificial Sequence
  Synthetic Construct
cguaguccuauucucugcugcuu

SEQ ID NO: 3503 - RNA, 20 nt, Artificial Sequence
  Synthetic Construct
aagacaucacaagacucuuu

SEQ ID NO: 3504 - RNA, 23 nt, Artificial Sequence
  Synthetic Construct
agguugggaucgguugcaaugcu

SEQ ID NO: 3505 - RNA, 22 nt, Artificial Sequence
  Synthetic Construct
ggguggggauuuguugcauuac

SEQ ID NO: 3506 - RNA, 22 nt, Artificial Sequence
  Synthetic Construct
agggacgggacgcggugcagug

SEQ ID NO: 3507 - RNA, 23 nt, Artificial Sequence
  Synthetic Construct
caaagugcuguucgugcagguag

SEQ ID NO: 3508 - RNA, 22 nt, Artificial Sequence
  Synthetic Construct
gagaggucucccugcgcacauu

SEQ ID NO: 3509 - RNA, 22 nt, Artificial Sequence
  Synthetic Construct
agugucuccaguaguagacauu

SEQ ID NO: 3510 - RNA, 23 nt, Artificial Sequence
  Synthetic Construct
gguagcggaagcgguaacugguu

SEQ ID NO: 3511 - RNA, 22 nt, Artificial Sequence
  Synthetic Construct
gcgauuccucccucuacuguuu

SEQ ID NO: 3512 - RNA, 20 nt, Artificial Sequence
  Synthetic Construct
gugagucaggguggggcugg

SEQ ID NO: 3513 - RNA, 22 nt, Artificial Sequence
  Synthetic Construct
uggguucaccuuuaagggcauu

SEQ ID NO: 3514 - RNA, 24 nt, Artificial Sequence
  Synthetic Construct
uggggagcugaggcucugggggug

SEQ ID NO: 3515 - RNA, 21 nt, Artificial Sequence
  Synthetic Construct
ggagcgggggcccugccuuuu

SEQ ID NO: 3516 - RNA, 23 nt, Artificial Sequence
  Synthetic Construct
acaugugcacacagccggguguu

SEQ ID NO: 3517 - RNA, 22 nt, Artificial Sequence
  Synthetic Construct
cacauggccgaaacagagaagu

SEQ ID NO: 3518 - RNA, 21 nt, Artificial Sequence
  Synthetic Construct
ggaggacggcaacagucaguu

SEQ ID NO: 3519 - RNA, 22 nt, Artificial Sequence
  Synthetic Construct
cauccgauguacaauaauuuuu

SEQ ID NO: 3520 - RNA, 22 nt, Artificial Sequence
  Synthetic Construct
uucaacggguauuuauugagca

SEQ ID NO: 3521 - RNA, 19 nt, Artificial Sequence
  Synthetic Construct
ggucaccaucuucccuuuu

SEQ ID NO: 3522 - RNA, 22 nt, Artificial Sequence
  Synthetic Construct
aaucaugugcagugccaauaug

SEQ ID NO: 3523 - RNA, 22 nt, Artificial Sequence
  Synthetic Construct
ugagguaguaaguuguauuguu

SEQ ID NO: 3524 - RNA, 22 nt, Artificial Sequence
  Synthetic Construct
aacccguagauccgaucuugug

SEQ ID NO: 3525 - RNA, 22 nt, Artificial Sequence
  Synthetic Construct
caagcucgugucuguggguccg

The invention claimed is:

1. A method for treating a lung cancer, comprising administering to a subject in need thereof a double-stranded oligo RNA structure comprising the following Formula (1):

A-X-R-Y-B            Formula (1)

wherein A represents a hydrophilic material, B represents a hydrophobic material, X and Y each independently represent a simple covalent bond or a linker-mediated covalent bond, and R represents an at least one miRNA, wherein said miRNA is miR-3670.

2. The method of claim 1, wherein the miRNA treats cancer by inducing apoptosis of cancer cell.

3. The method of claim 1, wherein the hydrophilic material is represented by $(A)_n$, $(A_m-J)_n$ or $(J-A_m)_n$, wherein A represents a hydrophilic material monomer, n represents 1 to 200, m represents 1 to 15, and J represents a linker that links m hydrophilic material monomers to one another, or links m hydrophilic material monomers to oligonucleotides.

4. The method of claim 1, wherein the hydrophilic material has a molecular weight of 200 to 10,000.

5. The method of claim 1, wherein the hydrophilic material is polyethylene glycol (PEG).

6. The method of claim 3, wherein the hydrophilic material monomer is the following compound (1):

Compound (1)

wherein Gin Compound (1) is selected from the group consisting of $CH_2$, O, S, and NH.

7. The method of claim 3, wherein the linker (J) is selected from the group consisting of $PO_3^-$, $SO_3$, and $CO_2$.

8. The method of claim 1, wherein the hydrophobic material has a molecular weight of 250 to 1,000.

9. The method of claim 1, wherein the hydrophobic material is selected from the group consisting of a steroid derivative, a glyceride derivative, glycerol ether, polypropylene glycol, $C_{12}$ to $C_{50}$ unsaturated or saturated hydrocarbon, diacyl-phosphatidylcholine, fatty acid, phospholipid, and lipopolyamine.

10. The method of claim 9, wherein the steroid derivative is selected from the group consisting of cholesterol, cholestanol, cholic acid, cholesteryl formate, cholestanyl formate and cholestanylamine.

11. The method of claim 9, wherein the glyceride derivative is selected from mono-, di- and tri-glyceride.

12. The method of claim 1, wherein the covalent bond represented by X and Y is a non-degradable or degradable bond.

13. The method of claim 12, wherein the non-degradable bond is an amide bond or a phosphoryl bond.

14. The method of claim 12, wherein the degradable bond is a disulfide bond, an acid-degradable bond, an ester bond, an anhydride bond, a biodegradable bond or an enzyme-degradable bond.

15. The method of claim 1, wherein miR-3670 comprises a double stranded RNA comprising a base sequence of SEQ ID NO. 35; and a base sequence of SEQ ID NO. 36 or SEQ ID NO. 67.

* * * * *